US006797466B1

(12) United States Patent
Bult et al.

(10) Patent No.: US 6,797,466 B1
(45) Date of Patent: Sep. 28, 2004

(54) **COMPLETE GENOME SEQUENCE OF THE METHANOGENIC ARCHAEON, *METHANOCOCCUS JANNASCHII***

(75) Inventors: Carol J. Bult, Bar Harbor, ME (US); Owen R. White, Gaithersburg, MD (US); Hamilton O. Smith, Baltimore, MD (US); Carl R. Woese, Urbana, IL (US); J. Craig Venter, Rockville, MD (US)

(73) Assignees: The Institute for Genomic Research, Rockville, MD (US); Johns Hopkins University, Baltimore, MD (US); The Board of Trustees of the University of Illinois, Urbana, IL (US)

( * ) Notice: Subject to any disclaimer, the term of this patent is extended or adjusted under 35 U.S.C. 154(b) by 137 days.

(21) Appl. No.: 09/692,570

(22) Filed: Oct. 20, 2000

Related U.S. Application Data

(63) Continuation of application No. 08/916,421, filed on Aug. 22, 1997.
(60) Provisional application No. 60/024,428, filed on Aug. 22, 1996.

(51) Int. Cl.$^7$ ................................................ C12Q 1/68
(52) U.S. Cl. ..................... 435/6; 435/320.1; 435/252.3; 435/325; 536/23.7; 536/24.32
(58) Field of Search .............................. 536/23.7, 24.32; 435/320.1, 325, 252.3, 64.1, 6

(56) References Cited

U.S. PATENT DOCUMENTS

| | | |
|---|---|---|
| 4,431,739 A | 2/1984 | Riggs |
| 4,601,980 A | 7/1986 | Goeddel et al. |
| 5,518,911 A | 5/1996 | Abo et al. |
| 5,919,620 A * | 7/1999 | Brodeur et al. ................. 435/6 |

OTHER PUBLICATIONS

GIBCOBRL, 1993–1994 Catalogue and Reference Guide, pp. R–114.*
Robert D. Fleischmann et al., Science, vol. 269 Jul 28, 1995, pp. 496–520.*
Akio Adachi et al., Journal of Virology, Aug. 1986, pp. 284–291.*
Almond et al., "Complementation of a thr–1 mutation of *Escherichia coli* by DNA from the extremely thermophilic archaebacteruim *Methanococcus jannaschii*," Appl. Microbiol. Biotechnol. 30:148–152 (1989).
Belay et al. "Dinitrogen fixation by a thermophilic methanogenic bacterium," Nature 312:286–288 (1984).
Bernad et al., "Structural and functional relationships between prokaryotic and eukaryotic DNA polymerases," EMBO J. 6(13):4219–4225 (1987).
Blaut et a., "Metaboism of methanogens," Antonie van Leeuwenhoek 66:187–208 (1994).

Brown et al., "Root of the universal tree of life based on ancient aminoacyl–tRNA synthetase gene duplications," Proc. Natl. Acad. Sci. USA 92:2441–2445 (1995).
Bult et al.., Science 273:1043–1045 and 1067–1072 (1996).
Cooper et al., "Protein splicing of the yeast TFP1 intervening protein sequence: a model for self–excision," EMBO J. 12(6):2575–2583 (1993).
Cooper et al., "Protein splicing: Self–Splicing of Genetically Mobile Elements at the Protein Level," TIBS 20:351–356 (1995).
Cullman et al., "Characterization of the five replication factor C genes of *Saccharomyces cerevisiae*," Mol. Cell. Biol. 15(9):4661–4671 (1995).
Delaure et al., "An attempt to unify the structure of polymerases," Protein Engineering 3(6):461–467 (1990).
De Pouplana et al., "Evidence that two present–day components needed for the genetic code appeared after nucleated cells separated from eubacteria," Proc. Natl. Acad. Sci. USA 93:166–170 (1996).
Dimarco et al., "Unusual coenzymes of methanogenesis," Annu. Rev. Biochem. 569:355–394 (1990).
Eberhart et al., "The pelota locus encodes a protein required for meiotic cell division: an analysis of $G_2/M$ arrest in Drosophila spermatogeneiss," Development 121:3477–3486 (1995).
Faguy et al., "Molecular analysis of aarchaeal flagellins: similarity to the type IV pilin—transport superfamily widwspread in bacteria," Can. J. Microbiol. 40:67–71 (1994).
Flieschmann et al., "Whole–genome random sequencing and assembly of *Haemophilus influenzae* Rd," Science 269:496–512 (1995).
Gavin et al., "Conserved initiator proteins in eukaryotes," Science 270:1667–1671 (1995).
GenBank report, "*B. thuringiensis* insertion element IS240–B protein gene, complete cds," Locus BACIS2402, Accession No. M23741 J03315 (1989), with associatd report for Locus Bank BACIS2401, Accession No. M23740 J03315 (1989).
GenBank report, "Insertion sequence IS982 (From *Lactococcus lactis*) transposase gene, c9mplete cds," Locus INSTRANB, Accession No. L34754 (1996).
Gogarten et al., "Evolution of the vacuolar $H^+$–ATPase: Implications for the origin of eukaryotes," Proc. Natl. Acad. Sci. USA 86:6661–6665 (1989).

(List continued on next page.)

*Primary Examiner*—Dave T Nguyen
*Assistant Examiner*—Richard Schnizer
(74) *Attorney, Agent, or Firm*—Human Genome Sciences, Inc.

(57) ABSTRACT

The present application describes the complete 1.66-megabase pair genome sequence of an autotrophic archaeon, *Methanococcus jannaschii*, and its 58- and 16-kilobase pair extrachromosomal elements. Also described are 1738 predicted protein-coding genes.

31 Claims, 2 Drawing Sheets

OTHER PUBLICATIONS

Hall et al., "Molecular cloning and primary structure of squid (*loligo forbesi*) rhodopsin, a phospholipase C–directed G–protein linked receptor," Biochem. J. 274 (Pt. 1):35–40; GenBank Accession No. X56788,. Dec. 21, 1994.

Hamilton et al., "Structure of genes and an insertion element in the methane producing archaebacterium *Methanobrevibacter smithii*," Mol. Gen. Genet. 200:47–59 (1985).

Hartman et al., "Uridine and dolichyl diphosphate activated oligosaccharides are intermediates in the biosynthesis of the S–layer glycoprotein of *Methanonthermus fervidus*," Arch. Microbiol. 151:274–281 (1989).

Hillier et al., "The WashU–Merck EST Project," GenBank Accession No. H46528, Jul. 31, 1995, Washington University School of Medicine, USA.

Hillier et al., "The WashU–Merck EST Project," GenBank Accession No. R07848, Apr. 5, 1995, Washington University School of Medicine, USA.

Hillier et al., "Washington University *Caenorhabditis briggsae* EST Project," GenBank Accession No. R04180, Mar. 31, 1995, Washington University School of Medicine, USA.

Hillier et al., "The WashU–Merck EST Project," GenBank Accession No. R08145, Apr. 5, 1995, Washington University School of Medicine, USA.

Hillier et al., "The WashU–Merck EST Project," GenBank Accession No. R15715, Apr. 13, 1995, Washington University School of Medicine, USA.

Hillier et al., "The WashU–Merck EST Project," GenBank Accession No. N21111, Dec. 19, 1995, Washington University School of Medicine, USA.

Hillier et al., "The WashU–Merck EST Project," GenBank Accession No. R96366, Sep. 11, 1995, Washington University School of Medicine, USA.

Hirata et al., "Molecular structure of a gene, VMA1, encoding the catalytic subunit of $H^+$–Translocating adenosine triphosphatase from vacuolar membranes of *Saccharomyces cerevisiae*," J. Biol. Chem. 265(12):6726–6733 (1990).

Iwabe et al. "Evolutionary relationship of archaebacteria, eubacteria, and eukaryotes inferred from phylogenetic trees of duplicated genes," Proc. Natl. Acad. Sci. USA 86:9355–9359 (1989).

Jiang et al., "Structure and sequence of the rfb (0 antigen) gene cluster of Salmonella serovar typhimurium (strain LT2)," Molec. Microbiol. 5(3):697–713 (1991).

Jones et al., "*Methanococcus jannaschii* sp. nov., an extremely thermophilic methanogen from a submarine hydrothermal vent," Arch. Microbiol. 136:254–261 (1983).

Kaine et al., "Isolation and characterization of the 7S RNA gene from *Methanococcus voltae*," J. Bacteriol. 171(8):4261–4266 (1989).

Kalmokoff et al., "Relatedness of the flagellins from methanogens," Arch. Microbiol. 157:481–487 (1992).

Kane et al., "Protein splicing converts the yeast TFP1 gene product to the 69–kD subunit of the vacuolar H+–adenosine triphosphatase," Science 250:651–657 (1990).

Klenk et al., "Archaea and eukaryotes versus bacteria?," Current Biology 4(10):920–922 (1994).

Köpke et al., "Comparative studies of ribosomal proteins and their genes from *Methanococcus vannielii* and other organisms," Can J. Microbiol. 35:11–20 (1989).

Langer et al., "Transcription in archaea: Similarity to that in eucarya," Proc. Natl. Acad. Sci. USA 92:5768–5772 (1995).

Lanzendorfer et al., "Structure and function of the DNA–dependent RNA polymerase of Sulfolobus," System. Appl. Microbiol. 16:656–664 (1994).

Lechner et al., "Organization and nucleotide sequence of a transcriptional unit of *Methanococcus vannielii* comprising genes for protein synthesis elongation factors and ribosomal proteins," J. Mol. Evol. 29:20–27 (1989).

Logan et al., "Crystal structure of glycyl–tRNA synthetase from *Thermus thermophilus*," EMBO J. 14(17):4156–4167 (1995).

Lutkenhaus, J. "*Escherichia coli* cell division," Curr. Opin. Genet. Devel. 3:783–788 (1993).

McCombie et al., "*Caenorhabditis elegans* expressed sequence tags identify gene families and potential disease gene homologoues", Nature Genet. 1:124–131; GenBank Accession No. M79739, (1992).

McCombie et al., "*Caenorhabditis briggsae* cDNAs," GenBank Accession No. T01773, Nov. 10, 1992, The Institute for Genomic Research, Rockville, MD, USA.

Michel et al., "Comparison of fungal mitochondrial introns reveals extensive homologies in RNA secondary structure," Biochimie 64:867–881 (1982).

Mojica et al., "Long stretches of short tandem repeats are present in the largest replicons of the Archaea *Haloferax mediterranei* and *Haloferax volcanii* and could be involved in replicon partitioning,": Molec. Microbiol. 17(1):85–93 (1995).

Perler et al., "Intervening sequences in an Archaea DNA polymerase gene," Proc. Natl. Acad. Sci. USA 89:5577–5581 (1992).

Pietrokovski et al., "Conserved sequence features of inteins (protein introns) and their use in identifying new inteins and related proteins," Protein Science 3:2340–2350 (1994).

Poritz et al., "Human SRP RNA and *E. coli* 4.5wS RNA contain a highly homologous structural Domain," Cell 55:4–6 (1988).

Riley et al., "Functions of the gene products of *Escherichia coli*," Microbiol. Rev. 57(4):862–952.

Rothfield et al., "How do bacterial decide where to divide?," Cell 84:183–186 (1996).

Sandman et al., "HMf, a DNA–binding protein isolated from the hyperthermophilic archaeon *Methanothermus fervidus*, is most closely related to histones," Proc. Natl. Acad. Sci. USA 87:5788–5791 (1990).

Schön et al., "Misaminoacylation and transamidation are required for protein biosynthesis in *Lactobacillus bulgaricus*," Biochimi 70:391–394 (1988).

Sevier et al., "Monoclonal antibodies in clinical immunology," Clin. Chem. 27(11):1979–1806 (1981).

Uemori et al., "The hyperthermophilic Archaeon *Pyrodictium occultum* has two α–like DNA polymerase," J. Bacteriol. 177(8):2164–2177 (1995).

Wagar et al., "The glycyl–tRNA synthetase of the *Chlamydia trachomatis*," J. Bacteriol. 177(17):5179–5185 (1994).

Whitbread et al., "Cdc54 belongs to the Cdc45/Mcm3 family of proteins which are esential for initiation of eukaryotic DNA replication," Gene 155:113–117 (1995).

Woese et al. "Towards a natural system of organisms: Proposal for the domains archaea, bacteria, and eucarya," Proc. Natl. Acad. Sci. USQ 87:4576–4579 (1990).

Wood et al., "The acetyl–CoA pathway: a newly discovered pathway of autotriphic growth," TIBS 11:14–18 (1986).

Xu et al., "In vitro protein splicing of purified precursor and the identification of a branched intermediate," Cell 75:1371–1377 (1993).

Zhao et al., "An extremely thermophilic Methanococcus from a deep see hydrothermal vent and its plasmid," Arch. Microbiol. 150:178–183 (1988).

International Search Report for International Application No. PCT/US97/14900.

* cited by examiner

COMPLETE GENOME SEQUENCE OF THE METHANOGENIC ARCHAEON, *METHANOCOCCUS JANNASCHII*

This application is a Continuation of U.S. application Ser. No. 08/916,421, filed Aug. 22, 1997, which is hereby incorporated by reference; said U.S. application Ser. No. 08/916,421 claims priority of U.S. Provisional Application No. 60/024,428, filed Aug. 22, 1996, which is hereby incorporated by reference.

Part of the work performed during development of this invention utilized U.S. Government funds. The U.S. Government may have certain rights in the invention—DE-FC02-95ER61962; DE-FCO2-95ER61963; and NAGW 2554.

BACKGROUND OF THE INVENTION

Statement as to Rights to Inventions Made Under Federally-Sponsored Research and Development 1. Reference to a Sequence Listing Provided on Compact Disc This application refers to a "Sequence Listing", which is provided as an electronic document on two identical compact discs (CD-R), labeled "Copy 1" and "Copy 2." These compact discs each contain the electronic document, filename "PB275C1.ST25.txt" (2,259,883 bytes in size, created on Nov. 14, 2002), which is hereby incorporated in its entirety herein.

2. Field of the Invention

The present application discloses the complete 1.66-megabase pair genome sequence of an autotrophic archaeon, *Methanococcus jannaschii*, and its 58- and 16-kilobase pair extrachromosomal elements. Also identified are 1738 predicted protein-coding genes.

3. Related Background Art

The view of evolution in which all cellular organisms are in the first instance either prokaryotic or eukaryotic was challenged in 1977 by the finding that on the molecular level life comprises three primary groupings (Fox, G. E., et al., *Proc. Natl. Acad. Sci. USA* 74:4537 (1977); Woese, C. R. & Fox, G. E., *Proc. Natl. Acad. Sci. USA* 74:5088 (1977); Woese, C. R., et al., *Proc. Natl., Acad. Sci. USA* 87:4576 (1990)): the eukaryotes (Eukarya) and two unrelated groups of prokaryotes, Bacteria and a new group now called the Archaea. Although Bacteria and Archaea are both prokaryotes in a cytological sense, they differ profoundly in their molecular makeup (Fox, G. E., et al., *Proc. Natl. Acad. Sci. USA* 74:4537 (1977); Woese, C. R. & Fox, G. E., *Proc. Natl. Acad. Sci. USA* 74:5088 (1977); Woese, C. R., et al., *Proc. Natl. Acad. Sci. USA* 87:4576 (1990)). Several lines of molecular evidence even suggest a specific relationship between Archaea and Eukarya (Iwabe, N., et al., *Proc. Natl. Acad. Sci. USA* 86:9355 (1989); Gogarten J. P., et al., *Proc. Natl. Acad. Sci. USA* 86:6661 (1989); Brown, J. R. and Doolittle, W. F., *Proc. Natl. Acad. Sci. USA* 92:2441 (1995)).

The era of true comparative genomics has been ushered in by complete genome sequencing and analysis. We recently described the first two complete bacterial genome sequences, those of *Haemophilus influenzae* and *Mycoplasma genitalium* (Fleischmann, R. D., et al., *Science* 269:496 (1995); Fraser, C. M., et al., *Science* 270:397 (1995)). Large scale DNA sequencing efforts also have produced an extensive collection of sequence data from eukaryotes, including *Homo sapiens* (Adams, M. D., et al., *Nature* 377:3 (1995)) and *Saccharomyces cerevisiae* (Levy, J., *Yeast* 10:1689 (1994)).

*M. jannaschii* was originally isolated by J. A. Leigh from a sediment sample collected from the sea floor surface at the base of a 2600 m deep "white smoker" chimney located at 21° N on the East Pacific Rise (Jones, W., et al., *Arch. Microbiol.* 136:254 (1983)). *M. jannaschii* grows at pressures of up to more than 500 atm and over a temperature range of 48–94° C. with an optimum temperature near 85° C. (Jones, W., et al., *Arch. Microbiol.* 136:254 (1983)). The organism is autotrophic and a strict anaerobe; and, as the name implies, it produces methane. The dearth of archaeal nucleotide sequence data has hampered attempts to begin constructing a comprehensive comparative evolutionary framework for assessing the molecular basis of the origin and diversification of cellular life.

SUMMARY OF THE INVENTION

The present invention is based on whole-genome random sequencing of an autotrophic archaeon, *Methanococcus jannaschii*. The *M. jannaschii* genome consists of three physically distinct elements: (i) a large circular chromosome; (ii) a large circular extrachromosomal element (ECE); and (iii) a small circular extrachromosomal element (ECE). The nucleotide sequences generated, the *M. jannaschii* chromosome, the large ECE, and the small ECE, are respectively provided on pages 153–586 (SEQ ID NO:1), pages 586–601 (SEQ ID NO:2), and pages 602–606 (SEQ ID NO:3).

The present invention is further directed to isolated nucleic acid molecules comprising open reading frames (ORFs) encoding *M. jannaschii* proteins. The present invention also relates to variants of the nucleic acid molecules of the present invention, which encode portions, analogs or derivatives of *M. jannaschii* proteins. Further embodiments include isolated nucleic acid molecules comprising a polynucleotide having a nucleotide sequence at least 90% identical, and more preferably at least 95%, 96%, 97%, 98% or 99% identical, to the nucleotide sequence of a *M. jannaschii* ORF described herein.

The present invention also relates to recombinant vectors, which include the isolated nucleic acid molecules of the present invention, host cells containing the recombinant vectors, as well as methods for making such vectors and host cells for *M. jannaschii* protein production by recombinant techniques.

The invention further provides isolated polypeptides encoded by the *M. jannaschii* ORFs. It will be recognized that some amino acid sequences of the polypeptides described herein can be varied without significant effect on the structure or function of the protein. If such differences in sequence are contemplated, it should be remembered that there will be critical areas on the protein which determine activity. In general, it is possible to replace residues which form the tertiary structure, provided that residues performing a similar function are used. In other instances, the type of residue may be completely unimportant if the alteration occurs at a non-critical region of the protein.

In another aspect, the invention provides a peptide or polypeptide comprising an epitope-bearing portion of a polypeptide of the invention. The epitope-bearing portion is an immunogenic or antigenic epitope useful for raising antibodies.

DETAILED DESCRIPTION OF THE INVENTION

Figure 1:
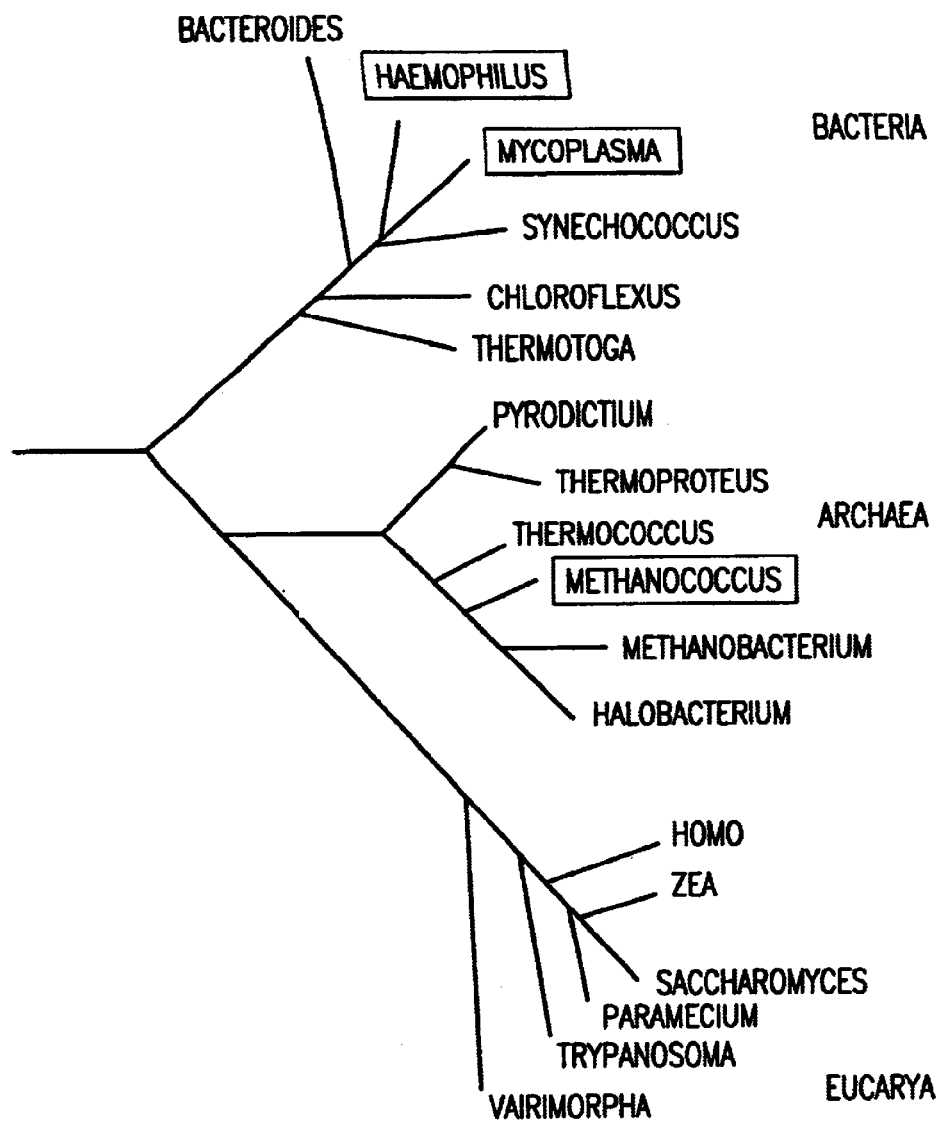
FIG. 1. A schematic showing the relationship of the three domains of life based on sequence data from the small subunit of rRNA (Fox, G. E., et al., Proc. Natl. Acad. Sci. USA 74:4537 (1977); Woese, C. R. & Fox, G. E., Proc. Natl. Acad. Sci. USA 74:5088 (1977); Woese, C. R., et al., Proc. Natl. Acad. Sci. USA 87:4576 (1990)).
Figure 2:
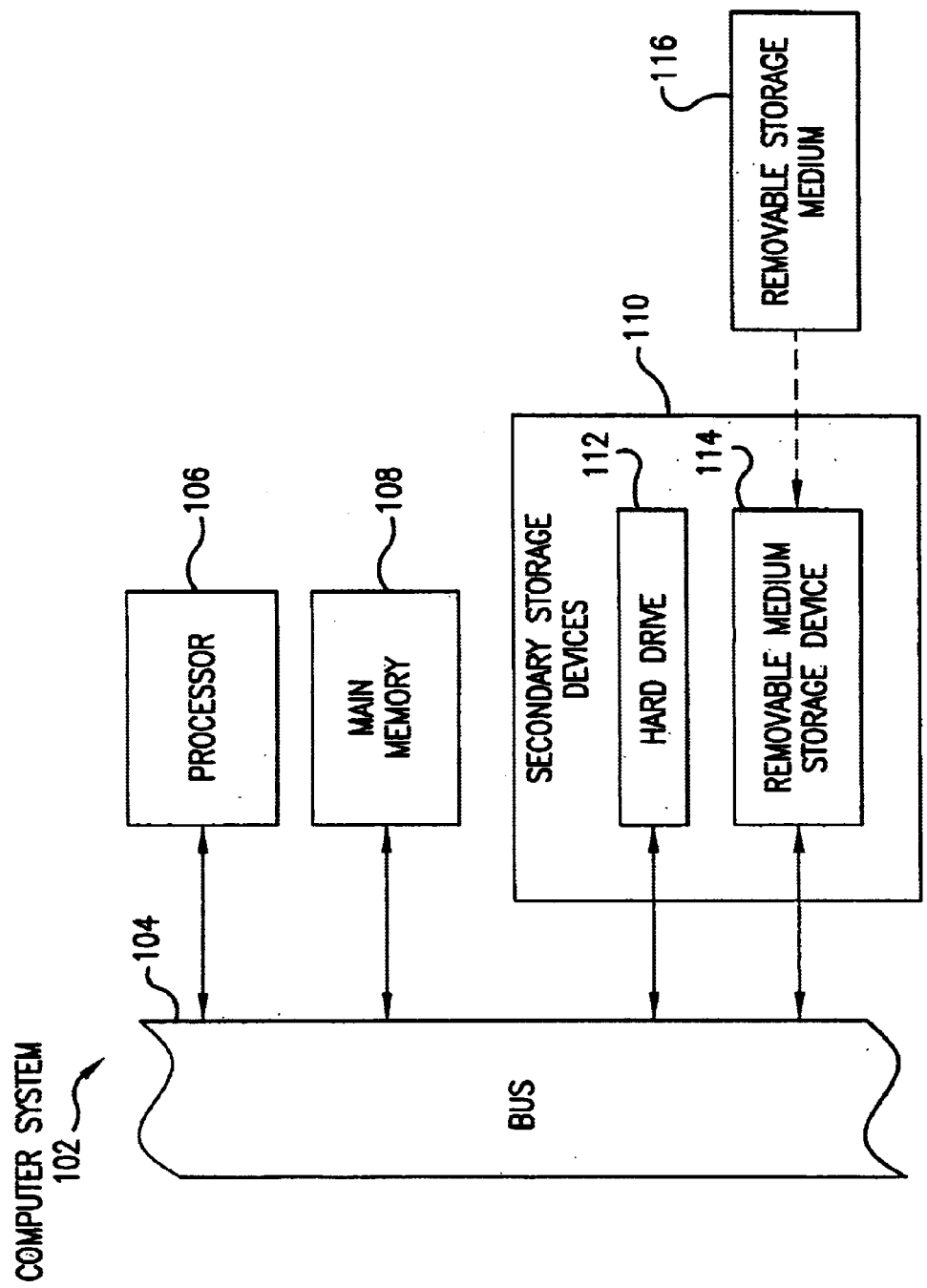
FIG. 2. Block diagram of a computer system 102 that can be used to implement the computer-based systems of present invention.

The present invention is based on whole-genome random sequencing of an autotrophic archaeon, Methanococcus jannaschii. The M. jannaschii genome consists of three physically distinct elements: (i) a large circular chromosome of 1,664,976 base pairs (bp) (shown on pages 153–586 and in SEQ ID NO:1), which contains 1682 predicted protein-coding regions and has a G+C content of 31.4%; (ii) a large circular extrachromosomal element (the large ECE) of 58,407 bp (shown on pages 586–601 and in SEQ ID NO:2), which contains 44 predicted protein-coding regions and has a G+C content of 28.2%; and (iii) a small circular extrachromosomal element (the small ECE) of 16,550 bp (shown on pages 602–606 and in SEQ ID NO:3), which contains 12 predicted protein-coding regions and has a G+C content of 28.8%.

The primary nucleotide sequences generated, the M. jannaschii chromosome, the large ECE, and the small ECE, are provided in SEQ ID NOs:1, 2, and 3, respectively. As used herein, the "primary sequence" refers to the nucleotide sequence represented by the IUPAC nomenclature system. The present invention provides the nucleotide sequences of SEQ ID NOs:1, 2, and 3, or a representative fragment thereof, in a form which can be readily used, analyzed, and interpreted by a skilled artisan.

As used herein; a "representative fragment" refers to M. jannaschii protein-encoding regions (also referred to herein as open reading frames), expression modulating fragments, uptake modulating fragments, and fragments that can be used to diagnose the presence of M. jannaschii in a sample. A non-limiting identification of such representative fragments is provided in Tables 2(a) and 3. As described in detail below, representative fragments of the present invention further include nucleic acid molecules having a nucleotide sequence at least 90% identical, preferably at least 95, 96%, 97%, 98%, or 99% identical, to an ORF identified in Table 2(a) or 3.

As indicated above, the nucleotide sequence information provided in SEQ ID NOs:1, 2 and 3 was obtained by sequencing the M. jannaschii genome using a megabase shotgun sequencing method. The sequences provided in SEQ ID NOs:1, 2 and 3 are highly accurate, although not necessarily a 100% perfect, representation of the nucleotide sequence of the M. jannaschii genome. As discussed in detail below, using the information provided in SEQ ID NOs:1, 2 and 3 and in Tables 2(a) and 3 together with routine cloning and sequencing methods, one of ordinary skill in the art would be able to clone and sequence all "representative fragments" of interest including open reading frames (ORFs) encoding a large variety of M. jannaschii proteins. In rare instances, this may reveal a nucleotide sequence error present in the nucleotide sequences disclosed in SEQ ID NOs:1, 2, and 3. Thus, once the present invention is made available (i.e., once the information in SEQ ID NOs:1, 2, and 3 and in Tables 2(a) and 3 have been made available), resolving a rare sequencing error would be well within the skill of the art. Nucleotide sequence editing software is publicly available. For example, Applied Biosystem's (AB) AutoAssembler™ can be used as an aid during visual inspection of nucleotide sequences.

Even if all of the rare sequencing errors were corrected, it is predicted that the resulting nucleotide sequences would still be at least about 99.9% identical to the reference nucleotide sequences in SEQ ID NOs:1, 2, and 3. Thus, the present invention further provides nucleotide sequences that are at least 99.9% identical to the nucleotide sequence of SEQ ID NO:1, 2, or 3 in a form which can be readily used; analyzed and interpreted by the skilled artisan. Methods for determining whether a nucleotide sequence is at least 99.9% identical to a reference nucleotide sequence of the present invention are described below.

Nucleic Acid Molecules

The present invention is directed to isolated nucleic acid fragments of the M. jannaschii genome. Such fragments include, but are not limited to, nucleic acid molecules encoding polypeptides (hereinafter open reading frames (ORFs)), nucleic acid molecules that modulate the expression of an operably linked ORF (hereinafter expression modulating fragments (EMFs)), nucleic acid molecules that mediate the uptake of a linked DNA fragment into a cell (hereinafter uptake modulating fragments (UMFs)), and nucleic acid molecules that can be used to diagnose the presence of M. jannaschii in a sample (hereinafter diagnostic fragments (DFs)).

By "isolated nucleic acid molecule(s)" is intended a nucleic acid molecule, DNA or RNA, that has been removed from its native environment. For example, recombinant DNA molecules contained in a vector are considered isolated for the purposes of the present invention. Further examples of isolated DNA molecules include recombinant DNA molecules maintained in heterologous host cells, purified (partially or substantially) DNA molecules in solution, and nucleic acid molecules produced synthetically. Isolated RNA molecules include in vitro RNA transcripts of the DNA molecules of the present invention.

In one embodiment, M. jannaschii DNA can be mechanically sheared to produce fragments about 15–20 kb in length, which can be used to generate a M. jannaschii DNA library by insertion into lambda clones as described in Example 1 below. Primers flanking an ORF described in Table 2(a) or 3 can then be generated using the nucleotide sequence information provided in SEQ ID NO:1, 2, or 3. The polymerase chain reaction (PCR) is then used to amplify and isolate the ORF from the lambda DNA library. PCR cloning is well known in the art. Thus, given SEQ ID NOs:1, 2, and 3, and Tables 2(a) and 3, it would be routine to isolate any ORF or other representative fragment of the *M. jannaschi* genome. Isolated nucleic acid molecules of the present invention include, but are not limited to, single stranded and double stranded DNA, and single stranded RNA, and complements thereof.

Tables 2(a), 2(b) and 3 describe ORFs in the *M. jannaschii* genome. In particular, Table 2(a) (pages 68–116 below) indicates the location of ORFs (i.e., the position) within the *M. jannaschii* genome that putatively encode the recited protein based on homology matching with protein sequences from the organism appearing in parentheticals (see the fourth column of Table 2(a)). The first column of Table 2(a) provides a name for each ORF. The second and third columns in Table 2(a) indicate an ORF's position in the nucleotide sequence provided in SEQ ID NO:1, 2 or 3. One of ordinary skill in the art will appreciate that the ORFs may be oriented in opposite directions in the *M. jannaschii* genome. This is reflected in columns 2 and 3. The fifth column of Table 2(a) indicates the percent identity of the protein sequence encoded by an ORF to the corresponding protein sequence from the organism appearing in parentheticals in the fourth column. The sixth column of Table 2(a) indicates the percent similarity of the protein sequence encoded by an ORF to the corresponding protein sequence from the organism appearing in parentheticals in the fourth column. The concepts of percent identity and percent similarity of two polypeptide sequences are well understood in the art and are described in more detail below. The eighth column in Table 2(a) indicates the length of the ORF in nucleotides. Each identified gene has been assigned a putative cellular role category adapted from Riley (Riley, M., *Microbiol. Rev.* 57:862 (1993)).

Table 2(b) (page 117 below) provides the single ORF identified by the present inventors that matches a previously published *M. jannaschii* gene. In particular, ORF MJ0479, which is 585 nucleotides in length and is positioned at nucleotides 1,050,508 to 1,049,948 in SEQ ID NO:1, shares 100% identity to the previously published *M. jannaschii* adenylate kinase gene.

Table 3 (pages 118–151 below) provides ORFs of the *M. jannaschii* genome that did not elicit a homology match with a known sequence from either *M. jannaschii* or another organism. As above, the first column in Table 3 provides the ORF name and the second and third columns indicate an ORF's position in SEQ ID NO:1, 2, or 3.

Table 4 (page 152 below) provides genes of *M. jannaschii* that contain inteins.

In the above-described Tables, there are three groups of ORF names. The one thousand six hundred and eighty two ORFs named "MJ-" (MJ0001-MJ1682) were identified on the *M. jannaschii* chromosome (SEQ ID NO:1). The forty four ORFs named "MJECL-" (MJECL01-MJECL44) were identified on the large ECE (SEQ ID NO:2). The twelve ORFs named "MJECS-" (MJECS01-MJES12) were identified on the small ECE (SEQ ID NO:3).

Further details concerning the algorithms and criteria used for homology searches are provided in the Examples below. A skilled artisan can readily identify ORFs in the *Methanococcus jannaschii* genome other than those listed in Tables 2(a), 2(b) and 3, such as ORFs that are overlapping or encoded by the opposite strand of an identified ORF in addition to those ascertainable using the computer-based systems of the present invention.

Isolated nucleic acid molecules of the present invention include DNA molecules having a nucleotide sequence substantially different than the nucleotide sequence of an ORF described in Table 2(a) or 3, but which, due to the degeneracy of the genetic code, still encode a *M. jannaschii* protein. The genetic code is well known in the art. Thus, it would be routine to generate such degenerate variants.

The present invention further relates to variants of the nucleic acid molecules of the present invention, which encode portions, analogs or derivatives of a *M. Jannaschii* protein encoded by an ORF described in Table 2(a) or 3. Non-naturally occurring variants may be produced using art-known mutagenesis techniques and include those produced by nucleotide substitutions, deletions or additions. The substitutions, deletions or additions may involve one or more nucleotides. The variants may be altered in coding regions, non-coding regions, or both. Alterations in the coding regions may produce conservative or non-conservative amino acid substitutions, deletions or additions. Especially preferred among these are silent substitutions, additions and deletions, which do not alter the properties and activities of the *M. jannaschii* protein or portions thereof. Also especially preferred in this regard are conservative substitutions.

Further embodiments of the invention include isolated nucleic acid molecules comprising a polynucleotide having a nucleotide sequence at least 90% identical, and more preferably at least 95%, 96%, 97%, 98% or 99% identical, to (a) the nucleotide sequence of an ORF described in Table 2(a) or 3, (b) the nucleotide sequence of an ORF described in Table 2(a) or 3, but lacking the codon for the N-terminal methionine residue, if present, or (c) a nucleotide sequence complementary to any of the nucleotide sequences in (a) or (b). By a polynucleotide having a nucleotide sequence at least, for example, 95% identical to the reference *M. jannaschii* ORF nucleotide sequence is intended that the nucleotide sequence of the polynucleotide is identical to the reference sequence except that the polynucleotide sequence may include up to five point mutations per each 100 nucleotides of the ORF sequence. In other words, to obtain a polynucleotide having a nucleotide sequence at least 95% identical to a reference ORF nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 90%, 95%, 96%, 97%, 98% or 99% identical to the nucleotide sequence of a *M. jannaschii* ORF can be determined conventionally using known computer programs such as the Bestfit program (Wisconsin Sequence Analysis Package, Version 8 for Unix, Genetics Computer Group, University Research Park, 575 Science Drive, Madison, Wis. 53711). Bestfit uses the local homology algorithm of Smith and Waterman, *Advances in Applied Mathematics* 2:482–489 (1981), to find the best segment of homology between two sequences. When using Bestfit or any other sequence alignment program to determine whether a particular sequence is, for instance, 95% identical to a reference sequence according to the present invention, the parameters are set, of course, such that the percentage of identity is calculated over the full length of the reference nucleotide sequence and that gaps in homology of up to 5% of the total number of nucleotides in the reference sequence are allowed.

Preferred are nucleic acid molecules having sequences at least 90%, 95%, 96%, 97%, 98% or 99% identical to the nucleic acid sequence of a *M. jannaschii* ORF that encode a functional polypeptide. By a "functional polypeptide" is intended a polypeptide exhibiting activity similar, but not necessarily identical, to an activity of the protein encoded by the *M. jannaschii* ORF. For example, the *M. jannaschii* ORF MJ1434 encodes an endonuclease that degrades DNA. Thus, a "functional polypeptide" encoded by a nucleic acid molecule having a nucleotide sequence, for example, 95% identical to the nucleotide sequence of MJ1434, will also degrade DNA. As the skilled artisan will appreciate, assays for determining whether a particular polypeptide is "functional" will depend on which ORF is used as the reference sequence. Depending on the reference ORF, the assay chosen for measuring polypeptide activity will be readily apparent in light of the role categories provided in Table 2(a).

Of course, due to the degeneracy of the genetic code, one of ordinary skill in the art will immediately recognize that a large number of the nucleic acid molecules having a sequence at least 90%, 95%, 96%, 97%, 98%, or 99% identical to the nucleic acid sequence of a reference ORF will encode a functional polypeptide. In fact, since degenerate variants all encode the same amino acid sequence, this will be clear to the skilled artisan even without performing a comparison assay for protein activity. It will be further recognized in the art that, for such nucleic acid molecules that are not degenerate variants, a reasonable number will also encode a functional polypeptide. This is because the skilled artisan is fully aware of amino acid substitutions that are either less likely or not likely to significantly affect protein function (e.g., replacing one aliphatic amino acid with a second aliphatic amino acid).

For example, guidance concerning how to make phenotypically silent amino acid substitutions is provided in Bowie, J. U. et al., "Deciphering the Message in Protein Sequences: Tolerance to Amino Acid Substitutions," *Science* 247:1306–1310 (1990), wherein the authors indicate that there are two main approaches for studying the tolerance of an amino acid sequence to change. The first method relies on the process of evolution, in which mutations are either accepted or rejected by natural selection. The second approach uses genetic engineering to introduce amino acid changes at specific positions of a cloned gene and selections or screens to identify sequences that maintain functionality. As the authors state, these studies have revealed that proteins are surprisingly tolerant of amino acid substitutions. The authors further indicate which amino acid changes are likely to be permissive at a certain position of the protein. For example, most buried amino acid residues require nonpolar side chains, whereas few features of surface side chains are generally conserved. Other such phenotypically silent substitutions are described in Bowie, J. U. et al., supra, and the references cited therein.

The present invention is further directed to fragments of the isolated nucleic acid molecules described herein. By a fragment of an isolated nucleic acid molecule having the nucleotide sequence of a *M. jannaschii* ORF is intended fragments at least about 15 nt, and more preferably at least about 20 nt, still more preferably at least about 30 nt, and even more preferably, at least about 40 nt in length that are useful as diagnostic probes and primers as discussed herein. Of course, larger fragments 50–500 nt in length are also useful according to the present invention as are fragments corresponding to most, if not all, of the nucleotide sequence of a *M. jannaschii* ORF. By a fragment at least 20 nt in length, for example, is intended fragments that include 20 or more contiguous bases from the nucleotide sequence of a *M. jannaschii* ORF. Since *M. jannaschii* ORFs are listed in Tables 2(a) and 3 and the genome sequence has been provided, generating such DNA fragments would be routine to the skilled artisan. For example, restriction endonuclease cleavage or shearing by sonication could easily be used to generate fragments of various sizes. Alternatively, such fragments could be generated synthetically.

Preferred nucleic acid fragments of the present invention include nucleic acid molecules encoding epitope-bearing portions of a *M. jannaschii* protein. Methods for determining such epitope-bearing portions are described in detail below.

In another aspect, the invention provides an isolated nucleic acid molecule comprising a polynucleotide that hybridizes under stringent hybridization conditions to a portion of the polynucleotide in a nucleic acid molecule of the invention described above, for instance, an ORF described in Table 2(a) or 3. By "stringent hybridization conditions" is intended overnight incubation at 42° C. in a solution comprising: 50% formamide, 5×SSC (750 mM NaCl, 75 mM trisodium citrate), 50 mM sodium phosphate (pH 7.6), 5×Denhardt's solution, 10% dextran sulfate, and 20 g/ml denatured, sheared salmon sperm DNA, followed by washing the filters in 0.1×SSC at about 65° C.

By a polynucleotide that hybridizes to a "portion" of a polynucleotide is intended a polynucleotide (either DNA or RNA) hybridizing to at least about 15 nucleotides (nt), and more preferably at least about 20 nt, still more preferably at least about 30 nt, and even more preferably about 30–70 nt of the reference polynucleotide. These are useful as diagnostic probes and primers as discussed above and in more detail below.

Of course, polynucleotides hybridizing to a larger portion of the reference polynucleotide (e.g., a *M. jannaschii* ORF), for instance, a portion 50–500 nt in length, or even to the entire length of the reference polynucleotide, are also useful as probes according to the present invention, as are polynucleotides corresponding to most, if not all, of a *M. jannaschii* ORF.

By "expression modulating fragment" (EMF), is intended a series of nucleotides that modulate the expression of an operably linked ORF or EMF. A sequence is said to "modulate the expression of an operably linked sequence" when the expression of the sequence is altered by the presence of the EMF. EMFs include, but are not limited to, promoters, and promoter modulating sequences (inducible elements). One class of EMFs are fragments that induce the expression of an operably linked ORF in response to a specific regulatory factor or physiological event. EMF sequences can be identified within the *M. jannaschii* genome by their proximity to the ORFs described in Tables 2(a), 2(b), and 3. An intergenic segment, or a fragment of the intergenic segment, from about 10 to 200 nucleotides in length, taken 5' from any one of the ORFs of Tables 2(a), 2(b) or 3 will modulate the expression of an operably linked 3' ORF in a fashion similar to that found with the naturally linked ORF sequence. As used herein, an "intergenic segment" refers to the fragments of the *M. jannaschii* genome that are between two ORF(s) herein described. Alternatively, EMFs can be identified using known EMFs as a target sequence or target motif in the computer-based systems of the present invention.

The presence and activity of an EMF can be confirmed using an EMF trap vector. An EMF trap vector contains a cloning site 5' to a marker sequence. A marker sequence encodes an identifiable phenotype, such as antibiotic resistance or a complementing nutrition auxotrophic factor, which can be identified or assayed when the EMF trap vector is placed within an appropriate host under appropriate conditions. As described above, an EMF will modulate the expression of an operably linked marker sequence. A more detailed discussion of various marker sequences is provided below.

A sequence that is suspected as being an EMF is cloned in all three reading frames in one or more restriction sites upstream from the marker sequence in the EMF trap vector. The vector is then transformed into an appropriate host using known procedures and the phenotype of the transformed host in examined under appropriate conditions. As described above, an EMF will modulate the expression of an operably linked marker sequence.

By "uptake modulating fragment" (UMF), is intended a series of nucleotides that mediate the uptake of a linked DNA fragment into a cell. UMFs can be readily identified using known UMFs as a target sequence or target motif with the computer-based systems described below. The presence and activity of a UMF can be confirmed by attaching the suspected UMF to a marker sequence. The resulting nucleic acid molecule is then incubated with an appropriate host under appropriate conditions and the uptake of the marker sequence is determined. As described above, a UMF will increase the frequency of uptake of a linked marker sequence.

By a "diagnostic fragment" (DF), is intended a series of nucleotides that selectively hybridize to *M. jannaschii* sequences. DFs can be readily identified by identifying unique sequences within the *M. jannaschii* genome, or by generating and testing probes or amplification primers consisting of the DF sequence in an appropriate diagnostic format for amplification or hybridization selectivity.

Each of the ORFs of the *M. jannaschii* genome disclosed in Tables 2(a) and 3, and the EMF found 5' to the ORF, can be used in numerous ways as polynucleotide reagents. The sequences can be used as diagnostic probes or diagnostic amplification primers to detect the presence *M. jannaschii* in a sample. This is especially the case with the fragments or ORFs of Table 3, which will be highly selective for *M. jannaschii*.

In addition, the fragments of the present invention, as broadly described, can be used to control gene expression through triple helix formation or antisense DNA or RNA, both of which methods are based on the binding of a polynucleotide sequence to DNA or RNA. Polynucleotides suitable for use in these methods are usually 20 to 40 bases in length and are designed to be complementary to a region of the gene involved in transcription (triple helix—see Lee et al., *Nucl. Acids Res.* 6:3073 (1979); Cooney et al., *Science* 241:456 (1988); and Dervan et al., *Science* 251:1360 (1991)) or to the mRNA itself (antisense—Okano, *J. Neurochem.* 56:560 (1991); *Oligodeoxynucleotides as Antisense Inhibitors of Gene Expression*, CRC Press, Boca Raton, Fla. (1988)).

Triple helix- formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide.

Vectors and Host Cells

The present invention further provides recombinant constructs comprising one or more fragments of the *M. jannaschii* genome. The recombinant constructs of the present invention comprise a vector, such as a plasmid or viral vector, into which, for example, a *M. jannaschii* ORF is inserted. The vector may further comprise regulatory sequences, including for example, a promoter, operably linked to the ORF. For vectors comprising the EMFs and UMFs of the present invention, the vector may further comprise a marker sequence or heterologous ORF operably linked to the EMF or UMF. Large numbers of suitable vectors and promoters are known to those of skill in the art and are commercially available for generating the recombinant constructs of the present invention. The following vectors are provided by way of example. Bacterial: pBs, phagescript, PsiX174, pBluescript SK, pBs KS, pNH8a, pNH16a, pNH18a, pNH46a (Stratagene); pTrc99A, pKK223-3, pKK233-3, pDR540, pRIT5 (Pharmacia). Eukaryotic: pWLneo, pSV2cat, pOG44, pXT1, pSG (Stratagene) pSVK3, pBPV, pMSG, pSVL (Pharmacia).

Promoter regions can be selected from any desired gene using CAT (chloramphenicol transferase) vectors or other vectors with selectable markers. Two appropriate vectors are pKK232-8 and pCM7. Particular named bacterial promoters include lacI, lacZ, T3, T7, gpt, lambda $P_R$, and trc. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art.

The present invention further provides host cells containing any one of the isolated fragments (preferably an ORF) of the *M. jannaschii* genome described herein. The host cell can be a higher eukaryotic host cell, such as a mammalian cell, a lower eukaryotic host cell, such as a yeast cell, or the can be a procaryotic cell, such as a bacterial cell. Introduction of the recombinant construct into the host cell can be effected by calcium phosphate transfection, DEAE, dextran mediated transfection, or electroporation (Davis, L. et al., *Basic Methods in Molecular Biology* (1986)). Host cells containing, for example, a *M. jannaschii* ORF can be used conventionally to produce the encoded protein.

Polypeptides and Fragments

The invention further provides an isolated polypeptide encoded by a *M. jannaschii* ORF described in Tables 2(a) or 3, or a peptide or polypeptide comprising a portion of the isolated polypeptide. The terms "peptide" and "oligopeptide" are considered synonymous (as is commonly recognized) and each term can be used interchangeably as the context requires to indicate a chain of at least two amino acids coupled by peptidyl linkages. The word "polypeptide" is used herein for chains containing more than ten amino acid residues.

It will be recognized in the art that some amino acid sequence of the *M. jannaschii* polypeptide can be varied without significant affect of the structure or function of the protein. If such differences in sequence are contemplated, it should be remembered that there will be critical areas on the protein which determine activity. In general, it is possible to replace residues which form the tertiary structure, provided that residues performing a similar function are used. In other instances, the type of residue may be completely unimportant if the alteration occurs at a non-critical region of the protein.

Thus, the invention further includes variations of a *M. jannaschii* protein encoded by an ORF described in Table 2(a) or 3 that show substantial protein activity. Methods for assaying such "functional polypeptides" for protein activity are described above. Variations include deletions, insertions, inversions, repeats, and type substitutions (for example, substituting one hydrophilic residue for another, but not strongly hydrophilic for strongly hydrophobic as a rule). Small changes or such "neutral" amino acid substitutions will generally have little effect on protein activity.

Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe, Tyr.

As indicated in detail above, further guidance concerning amino acid changes that are likely to be phenotypically silent (i.e., are not likely to have a significant deleterious effect on function) can be found in Bowie, J. U., et al., "Deciphering the Message in Protein Sequences: Tolerance to Amino Acid Substitutions," *Science* 247:1306–1310 (1990).

The fragment, derivative, variant or analog of a *M. jannaschii* polypeptide encoded by an ORF described in Table 2(a) or 3, may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which the polypeptide is fused with another compound, such as a compound to increase the half-life of the polypeptide (for example, polyethylene glycol), or (iv) one in which the additional amino acids are fused to the polypeptide, such as an IgG Fc fusion region peptide or leader or secretory sequence or a sequence which is employed for purification of the polypeptide or a proprotein sequence. Such fragments, derivatives and analogs are deemed to be within the scope of those skilled in the art from the teachings herein.

Of particular interest are substitutions of charged amino acids with another charged amino acid and with neutral or negatively charged amino acids. The latter results in proteins with reduced positive charge to improve the characteristics of a *M. jannaschii* ORF-encoded protein. The prevention of aggregation is highly desirable. Aggregation of proteins not only results in a loss of activity but can also be problematic when preparing pharmaceutical formulations, because they can be immunogenic. (Pinckard et al., *Clin. Exp. Immunol.* 2:331–340 (1967); Robbins et al., *Diabetes* 36:838–845 (1987); Cleland et al. *Crit. Rev. Therapeutic Drug Carrier Systems* 10:307–377 (1993)).

As indicated, changes are preferably of a minor nature, such as conservative amino acid substitutions that do not significantly affect the folding or activity of the protein (see Table 1).

TABLE 1

Conservative Amino Acid Substitutions.

| | |
|---|---|
| Aromatic | Phenylalanine |
| | Tryptophan |
| | Tyrosine |
| Hydrophobic | Leucine |
| | Isoleucine |
| | Valine |
| Polar | Glutamine |
| | Asparagine |
| Basic | Arginine |
| | Lysine |
| | Histidine |
| Acidic | Aspartic Acid |
| | Glutamic Acid |
| Small | Alanine |
| | Serine |
| | Threonine |
| | Methionine |
| | Glycine |

Amino acids in a *M. jannaschii* ORF-encoded protein of the present invention that are essential for function can be identified by methods known in the art, such a s site-directed mutagenesis or alanine-scanning mutagenesis (Cunningham and Wells, *Science* 244:1081–1085 (1989)). The latter procedure introduces single alanine mutaions at every residue in the molecule.

The polypeptides of the present invention are preferably provided in an isolated form. By "isolated polypeptide" is intended a polypeptide removed from its native environment. Thus, a polypeptide produced and/or contained within a recombinant host cell is considered isolated for purposes of the present invention. Also intended as an "isolated polypeptide" are polypeptides that hive been purified, partially or substantially, from a recombinant host cell. For example, a recombinant produced version of a *M. jannaschii* ORF-encoded protein can be substantially purified by the one-step method described in Smith and Johnson, *Gene* 67.231–40 (1988).

The polypeptides of the present invention include the proteins encoded by (a) an ORF described in Table 2(a) or 3 or (b) an ORF described in Table 2(a) or 3, but minus the codon for the N-terminal methionine residue, if present, as well as polypeptides that have at least 90% similarity, more preferably at least 95% similarity, and still more preferably at least 96%, 97%, 98% or 99% similarity to a *M. jannaschii* ORF-encoded protein. Further polypeptides of the present invention include polypeptides at least 90% identical, more preferably at least 95% identical, still more preferably at least 96%, 97%, 98% or 99% identical to a *M. jannaschii* ORF-encoded protein.

By "% similarity" for two polypeptides is intended a similarity score produced by comparing the amino acid sequences of the two polypeptides using the Bestfit program (Wisconsin Sequence Analysis Package, Version 8 for Unix, Genetics Computer Group, University Research Park, 575 Science Drive, Madison, Wis. 53711) and the default settings for determining similarity. Bestfit uses the local homology algorithm of Smith and Waterman (*Advances in Applied Mathematics* 2:482–489, 1981) to find the best segment of similarity between two sequences.

By a polypeptide having an amino acid sequence at least, for example, 95% "identical" to a reference amino acid sequence of a *M. jannaschii* ORF-encoded protein is intended that the amino acid sequence of the polypeptide is identical to the reference sequence except that the polypeptide sequence may include up to five amino acid alterations per each 100 amino acids of the reference sequence. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide has an amino acid sequence at least 90%, 95%, 96%, 97%, 98% or 99% identical to the amino acid sequence of a *M. jannaschii* ORF-encoded protein can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set, of course, such that the percentage of identity is calculated over the full length of the reference amino acid sequence and that gaps in homology of up to 5% of the total number of amino acid residues in the reference sequence are allowed.

As described in detail below, the polypeptides of the present invention can also be used to raise polyclonal and monoclonal antibodies, which are useful in assays for detecting *M. jannaschii* protein expression.

In another aspect, the invention provides a peptide or polypeptide comprising an epitope-bearing portion of a polypeptide of the invention. The epitope of this polypeptide portion is an immunogenic or antigenic epitope of a polypeptide of the invention. An "immunogenic epitope" is defined as a part of a protein that elicits an antibody response when the whole protein is the immunogen. These immunogenic epitopes are believed to be confined to a few loci on the molecule. On the other hand, a region of a protein molecule to which an antibody can bind is defined as an "antigenic epitope." The number of immunogenic epitopes of a protein generally is less than the number of antigenic epitopes. See, for instance, Geysen et al., *Proc. Natl. Acad. Sci. USA* 81:3998–4002 (1983).

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, for instance, Sutcliffe, J. G., Shinnick, T. M., Green, N. and Learner, R. A. (1983). Antibodies that react with predetermined sites on proteins are described in *Science* 219:660–666. Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals. Peptides that are extremely hydrophobic and those of six or fewer residues generally are ineffective at inducing antibodies that bind to the mimicked protein; longer, peptides, especially those containing proline residues, usually are effective. Sutcliffe et al., supra, at 661. For instance, 18 of 20 peptides designed according to these guidelines, containing 8–39 residues covering 75% of the sequence of the influenza virus hemagglutinin HAI polypeptide chain, induced antibodies that reacted with the HAI protein or intact virus; and 12/12 peptides from the MuLV polymerase and 18/18 from the rabies glycoprotein induced antibodies that precipitated the respective proteins.

Antigenic epitope-bearing peptides and polypeptides of the invention are therefore useful to raise antibodies, including monoclonal antibodies, that bind specifically to a polypeptide of the invention. Thus, a high proportion of hybridomas obtained by fusion of spleen cells from donors immunized with an antigen epitope-bearing peptide generally secrete antibody reactive with the native protein. Sutcliffe et al., supra, at 663. The antibodies raised by antigenic epitope-bearing peptides or polypeptides are useful to detect the mimicked protein, and antibodies to different peptides may be used for tracking the fate of various regions of a protein precursor which undergoes post-translational processing. The peptides and anti-peptide antibodies may be used in a variety of qualitative or quantitative assays for the mimicked protein, for instance in competition assays since it has been shown that even short peptides (e.g., about 9 amino acids) can bind and displace the larger peptides in immunoprecipitation assays. See, for instance, Wilson et al., *Cell* 37:767–778 (1984) at 777. The anti-peptide antibodies of the invention also are useful for purification of the mimicked protein, for instance, by adsorption chromatography using methods well known in the art.

Antigenic epitope-bearing peptides and polypeptides of the invention designed according to the above guidelines preferably contain a sequence of at least seven, more preferably at least nine and most preferably between about 15 to about 30 amino acids contained within the amino acid sequence of a polypeptide of the invention. However, peptides or polypeptides comprising a larger portion of an amino acid sequence of a polypeptide of the invention, containing about 30 to about 50 amino acids, or any length up to and including the entire amino acid sequence of a polypeptide of the invention, also are considered epitope-bearing peptides or polypeptides of the invention and also are useful for inducing antibodies that react with the mimicked protein. Preferably, the amino acid sequence of the epitope-bearing peptide is selected to provide substantial solubility in aqueous solvents (i.e., the sequence includes relatively hydrophilic residues and highly hydrophobic sequences are preferably avoided); and sequences containing proline residues are particularly preferred.

The epitope-bearing peptides and polypeptides of the invention may be produced by any conventional means for making peptides or polypeptides including recombinant means using nucleic acid molecules of the invention. For instance, a short epitope-bearing amino acid sequence may be fused to a larger polypeptide which acts as a carrier during recombinant production and purification, as well as during immunization to produce anti-peptide antibodies. Epitope-bearing peptides also may be synthesized using known methods of chemical synthesis. For instance, Houghten has described a simple method for synthesis of large numbers of peptides, such as 10–20 mg of 248 different 13 residue peptides representing single amino acid variants of a segment of the HA1 polypeptide which were prepared and characterized (by ELISA-type binding studies) in less than four weeks. Houghten, R. A. (1985) General method for the rapid solid-phase synthesis of large numbers of peptides: specificity of antigen-antibody interaction at the level of individual amino acids. *Proc. Natl. Acad. Sci. USA* 82:5131–5135. This "Simultaneous Multiple Peptide Synthesis (SMPS)" process is further described in U.S. Pat. No. 4,631,211 to Houghten et al. (1986). In this procedure the individual resins for the solid-phase synthesis of various peptides are contained in separate solvent-permeable packets, enabling the optimal use of the many identical repetitive steps involved in solid-phase methods. A completely manual procedure allows 500–1000 or more syntheses to be conducted simultaneously. Houghten et al, supra, at 5134.

Epitope-bearing peptides and polypeptides of the invention are used to induce antibodies according to methods well known in the art. See, for instance, Sutcliffe et al., supra; Wilson et al., supra; Chow, M. et al., *Proc. Natl. Acad. Sci. USA* 82:910–914; and Bittle, F. J. et al., *J. Gen Virol.* 66:2347–2354 (1985). Generally, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine may be coupled to carrier using a linker such as m-maleimidobenzoyl-N-hydroxysuccinimide ester (MBS), while other peptides may be coupled to carrier using a more general linking agent such as glutaraldehyde. Animals such as rabbits, rats and mice are immunized with either free or carrier-coupled peptides, for instance, by intraperitoneal and/or intradermal injection of emulsions containing about 100 g peptide or carrier protein and Freund's adjuvant. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

Immunogenic epitope-bearing peptides of the invention, i.e., those parts of a protein that elicit an antibody response when the whole protein is the immunogen, are identified according to methods known in the art. For instance, Geysen et al., supra, discloses a procedure for rapid concurrent synthesis on solid supports of hundreds of peptides of sufficient purity to react in an enzyme-linked immunosorbent assay. Interaction of synthesized peptides with antibodies is then easily detected without removing them from the support. In this manner a peptide bearing an immunogenic epitope of a desired protein may be identified routinely by one of ordinary skill in the art For instance, the immunologically important epitope in the coat protein of foot-and-mouth disease virus was located by Geysen et al. with a resolution of seven amino acids by synthesis of an overlapping set of all 208 possible hexapeptides covering the entire 213 amino acid sequence of the protein. Then, a complete replacement set of peptides in which all 20 amino acids were substituted in turn at every position within the epitope were synthesized, and the particular amino acids conferring specificity for the reaction with antibody were determined. Thus, peptide analogs of the epitope-bearing peptides of the invention can be made routinely by this method. U.S. Pat. No. 4,708,781 to Geysen (1987) further describes this method of identifying a peptide bearing an immunogenic epitope of a desired protein.

Further still, U.S. Pat. No. 5,194,392 to Geysen (1990) describes a general method of detecting or determining the sequence of monomers (amino acids or other compounds) which is a topological equivalent of the epitope (i.e., a "mimotope") which is complementary to a particular paratope (antigen binding site) of an antibody of interest. More generally, U.S. Pat. No. 4,433,092 to Geysen (1989) describes a method of detecting or determining a sequence of monomer which is a topographical equivalent of a ligand which is complementary to the ligand binding site of a particular receptor of interest. Similarly, U.S. Pat. No.

5,480,971 to Houghten, R. A. et al. (1996) on Peralkylated Oligopeptide Mixtures discloses linear $C_1$–$C_7$-alkyl peralkylated oligopeptides and sets and libraries of such peptides, as well as methods for using such oligopeptide sets and libraries for determining the sequence of a peralkylated oligopeptide that preferentially binds to an acceptor molecule of interest. Thus, non-peptide analogs of the epitope-bearing peptides of the invention also can be made routinely by these methods.

The entire disclosure of each document cited in this section on "Polypeptides and Peptides" is hereby incorporated herein by reference.

As one of skill in the art will appreciate, the polypeptides of the present invention and the epitope-bearing fragments thereof described above can be combined with parts of the constant domain of immunoglobulins (IgG), resulting in chimeric polypeptides. These fusion proteins facilitate purification and show an increased half-life in vivo. This has been demonstrated, e.g., for chimeric proteins consisting of the first two domains of the human CD4-polypeptide and various domains of the constant regions of the heavy or light chains of mammalian immunoglobulins (EPA 394,827; Traunecker et al., *Nature* 331:84–86 (1988)). Fusion proteins that have a disulfide-linked dimeric structure due to the IgG part can also be more efficient in binding and neutralizing other molecules than the monomeric protein or protein fragment alone (Fountoulakis et al., *J Biochem* 270:3958–3964 (1995)).

Protein Function

Each ORF described in Table 2(a) was assigned to biological role categories adapted from Riley, M., *Microbiology Reviews* 57(4):862 (1993)). This allows the skilled artisan to determine a function for each identified coding sequence. For example, a partial list of the *M. jannaschii* protein functions provided in Table 2(a) includes: methanogenesis, amino acid biosynthesis, cell division, detoxification, protein secretion, transformation, central intermediary metabolism, energy metabolism, degradation of DNA, DNA replication, restriction, modification, recombination and repair, transcription, RNA processing, translation, degradation of proteins, peptides and glycopeptides, ribosomal proteins, translation factors, transport, tRNA modification, and drug and analog sensitivity. A more detailed description of several of these functions is provided in Example 1 below.

Diagnostic Assays

The present invention further provides methods to identify the expression of an ORF of the present invention, or homolog thereof, in a test sample, using one of the DFs or antibodies of the present invention. Such methods involve incubating a test sample with one or more of the antibodies or one or more of the DFs of the present invention and assaying for binding of the DFs or antibodies to components within the test sample.

Conditions for incubating a DF or antibody with a test sample vary. Incubation conditions depend on the format employed in the assay, the detection methods employed, and the type and nature of the DF or antibody used in the assay. One skilled in the art will recognize that any one of the commonly available hybridization, amplification or immunological assay formats can readily be adapted to employ the DFs or antibodies of the present invention. Examples of such assays can be found in Chard, T., *An Introduction to Radioimmunoassay and Related Techniques*, Elsevier Science Publishers, Amsterdam, The Netherlands (1986); Bullock, G. R. et al., *Techniques in Immunocytochemistry*, Academic Press, Orlando, Fla. Vol. 1 (1982), Vol. 2 (1983), Vol. 3 (1985); Tijssen, P., *Practice and Theory of Enzyme Immunoassays: Laboratory Techniques in Biochemistry and Molecular Biology*, Elsevier Science Publishers, Amsterdam, The Netherlands (1985).

The test samples of the present invention include cells, protein or membrane extracts of cells. The test sample used in the above-described method will vary based on the assay format, nature of the detection method and the cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention. Specifically, the invention provides a compartmentalized kit to receive, in close confinement, one or more containers including comprising: (a) a first container comprising one of the DFs or antibodies of the present invention; and (b) one or more other containers comprising one or more of the following: wash reagents, reagents capable of detecting presence of a bound DF or antibody.

A compartmentalized kit includes any kit in which reagents are contained in separate containers. Such containers include small glass containers, plastic containers or strips of plastic or paper. Such containers allow one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or DF.

Types of detection reagents include labeled nucleic acid probes, labeled secondary antibodies, or in the alternative, if the primary antibody is labeled, the enzymatic, or antibody binding reagents that are capable of reacting with the labeled antibody. One skilled in the art will readily recognize that the disclosed DFs and antibodies of the present invention can be readily incorporated into one of the established kit formats that are well known in the art.

Screening Assay for Binding Agents

Using the isolated proteins described herein, the present invention further provides methods of obtaining and identifying agents that bind to a protein encoded by a *M. jannaschii* ORF or to a fragment thereof.

The method involves:

(a) contacting an agent with an isolated protein encoded by a M. jannaschii ORF, or an isolated fragment thereof; and (b) determining whether the agent binds to said protein or said fragment.

The agents screened in the above assay can be, but are not limited to, peptides, carbohydrates, vitamin derivatives, or other pharmaceutical agents. The agents can be selected and screened at random or rationally selected or designed using protein modeling techniques. For random screening, agents such as peptides, carbohydrates, pharmaceutical agents and the like are selected at random and are assayed for their ability to bind to the protein encoded by an ORF of the present invention.

Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like capable of binding to a specific peptide sequence in order to generate rationally designed antipeptide peptides, for example see Hurby et al., Application of Synthetic Peptides: Antisense Peptides, In *Synthetic Peptides, A User's Guide*, W. H. Freeman, NY (1992), pp. 289–307, and Kaspczak et al., *Biochemistry* 28:9230–8 (1989), or pharmaceutical agents, or the like.

In addition to the foregoing, one class of agents of the present invention, can be used to control gene expression through binding to one of the ORFs or EMFs of the present invention. As described above, such agents can be randomly screened or rationally designed and selected. Targeting the ORF or EMF allows a skilled artisan to design sequence specific or element specific agents, modulating the expression of either a single ORF or multiple ORFs that rely on the same EMF for expression control.

One class of DNA binding agents are those that contain nucleotide base residues that hybridize or form a triple helix by binding to DNA or RNA. Such agents can be based on the classic phosphodiester, ribonucleic acid backbone, or can be a variety of sulfhydryl or polymeric derivatives having base attachment capacity.

Agents suitable for use in these methods usually contain 20 to 40 bases and are designed to be complementary to a region of the gene involved in transcription (triple helix—see Lee et al., *Nucl. Acids Res.* 6:3073 (1979); Cooney et al, *Science* 241:456 (1988); and Dervan et al., *Science* 251: 1360 (1991)) or to the mRNA itself (antisense—Okano, *J. Neurochem.* 56:560 (1991); *Oligodeoxynucleotides as Antisense Inhibitors of Gene Expression*, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide and other DNA binding agents.

Computer Related Embodiments

The nucleotide sequence provided in SEQ ID NO:1, 2, or 3, a representative fragment thereof, or a nucleotide sequence at least 99.9% identical to the sequence provided in SEQ ID NO:1, 2, or 3, can be "provided" in a variety of mediums to facilitate use thereof. As used herein, provided refers to a manufacture, other than an isolated nucleic acid molecule, that contains a nucleotide sequence of the present invention, i.e., the nucleotide sequence provided in SEQ ID NO:1, 2, or 3, a representative fragment thereof, or a nucleotide sequence at least 99.9% identical to SEQ ID NO:1, 2, or 3. Such a manufacture provides the M. jannaschii genome or a subset thereof (e.g., a M. jannaschii open reading frame (ORF)) in a form that allows a skilled artisan to examine the manufacture using means not directly applicable to examining the M. jannaschii genome or a subset thereof as it exists in nature or in purified form.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently know methods for recording information on computer readable medium to generate manufactures comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and MicroSoft Word, or represented in the form of an ASCII file, stored in a database application, such as DB2, Sybase, Oracle, or the like. A skilled artisan can readily adapt any number of dataprocessor structuring formats (e.g. text file or database) in order to obtain computer readable medium having recorded thereon the nucleotide sequence information of the present invention.

By providing the nucleotide sequence of SEQ ID NO:1, 2, or 3, a representative fragment thereof, or a nucleotide sequence at least 99.9% identical to SEQ ID NO:1, 2, or 3, in computer readable form, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403410 (1990)) and BLAZE (Brutiag et al., *Comp. Chem.* 17:203–207 (1993)) search algorithms on a Sybase system can be used to identify open reading frames (ORFs) within the *M. jannaschii* genome that contain homology to ORFs or proteins from other organisms. Such ORFs are protein-encoding fragments within the *M. jannaschii* genome and are useful in producing commercially important proteins such as enzymes used in methanogenesis, amino acid biosynthesis, metabolism, fermentation, transcription, translation, RNA processing, nucleic acid and protein degradation, protein modification, and DNA replication, restriction, modification, recombination, and repair. A comprehensive list of ORFs encoding commercially important *M. jannaschii* proteins is provided in Tables 2(a) and 3.

The present invention further provides systems, particularly computer-based systems, which contain the sequence information described herein. Such systems are designed to identify commercially important fragments of the *M. jannaschii* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the *M. jannaschii* genome that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTN and BLASTX (NCBIA). A skilled artisan can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that during searches for commercially important fragments of the *M. jannaschii* genome, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzymic active sites and signal sequences. Nucleic acid target motifs include, but are not limited to, promoter sequences, hairpin structures and inducible expression elements (protein binding sequences).

Thus, the present invention further provides an input means for receiving a target sequence, a data storage means for storing the target sequence and the homologous *M. jannaschii* sequence identified using a search means as described above, and an output means for outputting the identified homologous *M. jannaschii* sequence. A variety of structural formats for the input and output means can be used to input and output information in the computer-based systems of the present invention. A preferred format for an output means ranks fragments of the *M. jannaschii* genome possessing varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments of the *M. jannaschii* genome. For example, implementing software which implement the BLAST and BLAZE algorithms (Altschul et al., *J. Mol. Biol.* 215:403–410 (1990)) can be used to identify open reading frames within the *M. jannaschii* genome. A skilled artisan can readily recognize that any one of the publicly available homology search programs can be used as the search means for the computer-based systems of the present invention.

One application of this embodiment is provided in FIG. 8. FIG. 8 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable medium storage device 114 once inserted in the removable medium storage device 114.

A nucleotide sequence of the present invention may be stored in a well known manner in the main memory 108, any of the secondary storage devices 110, and/or a removable storage medium 116. Software for accessing and processing the genomic sequence (such as search tools, comparing tools, etc.) reside in main memory 108 during execution.

Having generally described the invention, the same will be more readily understood by reference to the following examples, which are provided by way of illustration and are not intended as limiting.

EXPERIMENTAL

COMPLETE GENOME SEQUENCE OF THE METHANOGENIC ARCHAEON, *METHANOCOCCUS JANNASCHII*

EXAMPLE 1

A whole genome random sequencing method (Fleischmann, R. D., et al., *Science* 269:496 (1995); Fraser, C. M., et al., *Science* 270:397 (1995)) was used to obtain the complete genome sequence for *M. jannaschii*. A small insert plasmid library (2.5 Kbp average insert size) and a large insert lambda library (16 Kbp average insert size) were used as substrates for sequencing. The lambda library was used to form a genome scaffold and to verify the orientation and integrity of the contigs formed from the assembly of sequences from the plasmid library. All clones were sequenced from both ends to aid in ordering of contigs during the sequence assembly process. The average length of sequencing reads was 481 bp. A total of 36,718 sequences were assembled by means of the TIGR Assembler (Fleischmann, R. D., et al., Science 269:496 (1995); Fraser, C. M., et al., *Science* 270:397 (1995); Sutton G., et al, *Genome Sci. Tech.* 1:9 (1995)). Sequence and physical gaps were closed using a combination of strategies (Fleischmann, R. D., et al., *Science* 269:496 (1995); Fraser, C. M., et al., *Science* 270:397 (1995)). The colinearity of the in vivo genome to the genome sequence was confirmed by comparing restriction fragments from six, rare cutter, restriction enzymes (Aat II, BamHI, Bgl II, Kpn I, Sma I, and Sst II) to those predicted from the sequence data Additional confidence in the colinearity was provided by the genome scaffold produced by sequence pairs from 339 large-insert lambda clones, which covered 88% of the main chromosome. Open reading frames (ORFs) and predicted protein-coding regions were identified as described (Fleischmann, R. D., et al., *Science* 269:496 (1995); Fraser, C. M., et al., *Science* 270:397 (1995)) with some modification. In particular, the statistical prediction of *M. jannaschii* genes was performed with GeneMark (Borodovsky, M. & McIninch, *J. Comput. Chem.* 17:123 (1993)). Regular GeneMark uses nonhomogeneous Markov models derived from a training set of coding sequences and ordinary Markov models derived from a training set of noncoding sequences. Only a single 16S ribosomal RNA sequence of *M. jannaschii* was available in the public sequence databases before the whole genome sequence described here. Thus, the initial training set to determine parameters of a coding sequence Markov model was chosen as a set of ORFs>1000 nucleotides (nt). As an initial model for non-coding sequences, a zero-order Markov model with genome-specific nucleotide frequencies was used. The initial models were used at the first prediction step. The results of the first prediction were then used to compile a set of putative genes used at the second training step. Alternate rounds of training and predicting were continued until the set of predicted genes stabilized and the parameters of the final fourth-order model of coding sequences were derived. The regions predicted as noncoding were then used as a training set for a final model for noncoding regions. Cross-validaton simulations demonstrated that the GeneMark program trained as described above was able to correctly identify coding regions of at least 96 nt in 94% of the cases and noncoding regions of the same length in 96% of the cases. These values assume that the self-training method produced correct sequence annotation for compiled control sets. Comparison with the results obtained by searches against a nonredundant protein database (Fleischmann, R. D., et al., *Science* 269:496 (1995); Fraser, C. M., et al., *Science* 270:397 (1995)) demonstrated that almost all genes identified by sequence similarity were predicted by the GeneMark program as well. This observation provides additional confidence in genes predicted by GeneMark whose protein translations did not show significant similarity to known protein sequences. The predicted protein-coding regions were search against the Blocks database (Henikoff, S. & Henikoff, J. G., *Genomics* 19:97 (1994)] by means of BLIMPS (Wallace, J. C. & Henikoff, S., *CABIOS* 8:249 (1992)) to verify putative identifications and to identify potential functional motifs in predicted protein-coding regions that had no database match. Genes were assigned to known metabolic pathways. When a gene appeared to be missing from a pathway, the unassigned ORFs and the complete *M. jannaschii* genome sequence were searched with specific query sequences or motifs from the Blocks database. Hydrophobicity plots were performed on all predicted protein-coding regions by means of the Kyte-Doolittle algorithm (Kyte, J. & Doolittle, R. F., *J. Mol. Biol.* 157:105 (1982)) to identify potentially functionally relevant signatures in these sequences.

The *M. jannaschii* genome comprises three physically distinct elements: i) a large circular chromosome of 1,664, 976 base pairs (bp) (SEQ ID NO:1), which contains 1682 predicted protein-coding regions and has a G+C content of 31.4%; ii) a large circular extrachromosomal element (ECE) (Zhao, H., et al., *Arch. Microbiol.* 150:178 (1988)) of 58,407 bp (SEQ ID NO:2), which contains 44 predicted protein coding regions and has a G+C content of 28.2% (FIG. 3); and iii) a small circular ECE (Zhao, H., et al., *Arch. Microbiol.* 150:178 (1988)) of 16,550 bp (SEQ ID NO:3), which contains 12 predicted protein coding regions, and has a G+C content of 28.8% (FIG. 3). With respect to its shape, size, G+C content, and gene density the main chromosome resembles that of *H. influenzae*. However, here the resemblance stops.

Of the 1743 predicted protein-coding regions reported previously for *H. influenzae*, 78% had a match in the public sequence database (Fleischmann, R. D., et al., *Science* 269:496 (1995); Fraser, C. M., et al, *Science* 270:397 (1995)). Of these, 58% were matches to genes with reasonably well defined function, while 20% were matches to genes whose function was undefined. Similar observations were made for the *M. genitalium* genome (Fleischmann, R. D., et al., *Science* 269:496 (1995); Fraser, C. M., et al., *Science* 270:397 (1995)). Eighty-three percent of the predicted protein coding regions from *M. genitalium* have a counterpart in the *H. influenzae* genome. In contrast, only 38% of the predicted protein-coding regions from *M. jannaschii* match a gene in the database that could be assigned a putative cellular role with high confidence; 6% of the predicted protein-coding regions had matches to hypothetical proteins (FIG. 4; Tables 2–3). Approximately 100 genes in *M. jannaschii* had marginal similarity to genes or segments of genes from the public sequence databases and could not be assigned a putative cellular role with high confidence. Only 11% of the predicted protein-coding regions from *H. influenzae* and 17% of the predicted protein coding regions from *M. genitalium* matched a predicted protein coding region from *M. jannaschii*. Clearly the *M. jannaschii* genome, and undoubtedly, therefore, all archaeal genomes are remarkably unique, as the phylogenetic position of these organisms would suggest.

Energy production in *M. jannaschii* occurs via the reduction of $CO_2$ with $H_2$ to produce methane. Genes for all of the known enzymes and enzyme complexes associated with methanogenesis (DiMarco, A. A., et al., *Ann. Rev. Biochem.* 59:355 (1990)) were identified in *M. jannaschii*, the sequence and order of which are typical of methanogens. *M. jannaschii* appears to use both $H_2$ and formate as substrates for methanogenesis, but lacks the genes to use methanol or acetate. The ability to fix nitrogen has been demonstrated in a number of methanogens (Belay, N., et al., *Nature* 312:286 (1984)) and all of the genes necessary for this pathway have been identified in *M. jannaschii* (Tables 2–3). In addition to its anabolic pathways, several scavenging molecules have been identified in *M. jannaschii* that probably play a role in importing small organic compounds, such as amino acids, from the environment (Tables 2–3).

Three different pathways are known for the fixation of $CO_2$ into organic carbon: the non-cyclic, reductive acetyl-coenzyme A-carbon monoxide dehydrogenase pathway (Ljungdahl-Wood pathway), the reductive trichloroacetic acid (TCA) cycle, and the Calvin cycle. Methanogens fix carbon by the Ljungdahl-Wood pathway (Wood, H. G., et al., *TIBS* 11:14 (1986)), which is facilitated by the carbon monoxide dehydrogenease enzyme complex (CODH) (Blaat, M., *Antonie van Leewenhoek* 66:187 (1994)). The complete Ljungdahl-Wood pathway, encoded in the *M. jannaschii* genome, depends on the methyl carbon in methanogenesis; however, methanogenesis can occur independently of carbon fixation.

Although genes encoding two enzymes required for gluconeogenesis (glucopyruvate oxidoreductase and phosphoenolpyruvate synthase) were found in the *M. jannaschii* genome, genes encoding other key intermediates of gluconeogenesis (fructose bisphosphatase and fructose 1,6-bisphosphate aldolase) were not been identified. Glucose catabolism by glycolysis also requires the aldolase, as well as phosphofructokinase, an enzyme that also was not found in *M. jannaschii* and has not been detected in any of the Archaea. In addition, genes specific for the Entner-Doudoroff pathway, an alternative pathway used by some microbes for the catabolism of glucose, were not identified in the genomic sequence. The presence of a number of nearly complete metabolic pathways suggests that some key genes are not recognizable at the sequence level, although we cannot exclude the possibility that *M. jannaschii* may use alternative metabolic pathways.

In general, *M. jannaschii* genes that encode proteins involved in the transport of small inorganic ions into the cell are homologs of bacterial genes. The genome includes many representatives of the ABC transporter family, as well as genes for exporting heavy metals (e.g., the chromate-resistance protein) and other toxic compounds (e.g the nor A drug efflux pump locus).

More than 20 predicted protein-coding regions have sequence similarity to polysaccharide biosynthetic enzymes. These genes have only bacterial homologs or are most closely related to their bacterial counterparts. The identified polysaccharide biosynthetic genes in *M. jannaschii* include those for the interconversion of sugars, activation of sugars to nucleotide sugars, and glycosyltransferases for the polymerization of nucleotide sugars into oligo- and polysaccharides that are subsequently incorporated into surface structures (Hartmann, E. and König, H., *Arch Microbiol.* 151:274 (1989)). In an arrangement reminiscent of bacterial polysaccharide biosynthesis genes, many of the genes for *M. jannaschii* polysaccharide production are clustered together (Tables 2–3, FIG. 4). The G+C content in this region is <95% of that in the rest of the *M. jannaschii* genome. A similar observation was made in *Salmonella typhimurium* (Jiang, X. M., et al., *Mol. Microbiol.* 5:695 (1991)) in which the gene cluster for lipopolysaccharide 0 antigen has a significantly lower G+C ratio than the rest of the genome. In that case, the difference in G+C content was interpreted as meaning that the region originated by lateral transfer from another organism.

Of the three main multicomponent information processing systems (transcription, translation, and replication), translation appears the most universal in its overall makeup in that the basic translation machinery is similar in all three domains of life. *M. jannaschii* has two ribosomal RNA operons, designated A and B, and a separate 5S RNA gene that is associated with several transfer RNAs (tRNAs). Operon A has the organization, 16S—23S—5S, whereas operon B lacks the 5S component An alanine tRNA is situated in the spacer region between the 16S and 23S subunits in both operons. The majority of proteins associated with the ribosomal subunits (especially the small subunit) are present in both Bacteria and Eukaryotes. However, the relatively protein-rich eukaryotic ribosome contains additional ribosomal proteins not found in the bacterial ribosome. A smaller number of bacteria-specific ribosomal proteins exist as well. The *M. jannaschii* genome contains all ribosomal proteins that are common to eukaryotes and bacteria. It shows no homologs of the bacterial-specific ribosomal proteins, but does possess homologs of a number of the eukaryotic-specific ones. Homologs of all archaea-specific ribosomal proteins that have been reported to date (Lechner, K., et al., *J. Mol. Evol.* 29:20 (1989); Köpke, A. K. E. and Wittimann-Liebold, B., *Can. J. Microbiol.* 35:11 (1989)) are found in *M. jannaschii*.

As previously shown for other archaea (Iwabe, N., et al., *Proc. Natl. Acad. Sci. USA* 86:9355 (1989); Gogarten J. P., et al., *Proc. Natl. Acad. Sci. USA* 86:6661 (1989); Brown, J. R. and Doolittle, W. F., *Proc. Natl. Acad. Sci. USA* 92:2441 (1995)), the Methanococcus translation elongation factors EF-1α (EF-Tu in bacteria) and EF-2 (EF-G in bacteria) are most similar to their eukaryotic counterparts. In addition, the *M. jannaschii* genome contains 11 translation initiation factor genes. Three of these genes encode the subunits homologous to those of the eukaryotic IF-2, and are reported here in the Archaea for the first time. A fourth initiation factor gene that encodes a second IF-2 is also found in *M. jannaschii*. This additional IF-2 gene is most closely related to the yeast protein FUN12 which, in turn, appears to be a homolog of the bacterial IF-2. It is not known which of the two IF-2-like initiation factors identified in *M. jannaschii* plays a role in directing the initiator tRNA to the start site of the mRNA. The fifth identified initiation factor gene in *M. jannaschii* encodes IF-1A, which has no bacterial homolog. The sixth gene encodes the hypusine-containing initiation factor eIF-5a. Two subunits of the translation initiation factor eIF-2B were identified in *M. jannaschii*. Finally, three putative adenososine 5'-triphosphate (ATP)-dependent helicases were identified that belong to the eIF-4a family of translation initiation factors.

Thirty-seven tRNA genes were identified in the *M. jannaschii* genome. Almost all amino acids encoded by two codons have a single TRNA, except for glutamic acid, which has two. Both an initiator and an internal methionyl tRNA are present. The two pyrimidine-ending isoleucine codons are covered by a single tRNA, while the third (AUA) seems covered by a related tRNA having a CAU anticodon. A single tRNA appears to cover the three isoleucine codons. Those amino acids encoded by f our codons each have two tRNAs, one to cover the Y-, the other the R-ending, codons. Valine has a third tRNA, which is specific for the GUG codon; and alanine has three tRNAs (two of which are in the spacer regions separating the 16S and 23S subunits in the two ribosomal RNA operons). Leucine, serine and arginine, all of which have six codons, each posses three corresponding tRNAs. The genes for the internal methionine and tryptophan tRNAs contain introns in the region of their anti-codon loops.

A tRNA also exists for selenocysteine UGA codon). At least four genes in *M. jannaschii* contain internal stop codons that are potential selenocysteine codons: the α chain of formate dehydrogenase, coenzyme F420 reducin hydrognase, β-chain tungsten formyl methanofuran dehydrogenase, and a heterodisulfide reductase. Three genes with a putative role in selenocysteine metabolism were identified by their similarity to the sel genes from other organisms (Tables 2–3).

Recognizable homologs for four of the aminoacyl-tRNA synthetases (glutamine, asparagine, lysine, and cysteine) were not identified in the *M. jannaschii* genome. The absence of a glutaminyl-tRNA synthetase is not surprising in that a number of organisms, including at least one archaeon, have none (Wilcox, M., *Eur. J Biochem.* 11:405 (1969); Martin, N. C., et al., *J. Mol. Biol.* 101:285 (1976); Martin, N. C., et al., *Biochemistry* 16:4672 (1977); Schon, A., et al., *Biochimie* 70:391 (1988); Soll, D. and RajBhandary, U., Eds. *Am. Soc. for Microbiol.* (1995)). In these instances, glutaminyl tRNA charging involves a post-charging conversion mechanism whereby the tRNA is charged by the glutamyl-tRNA synthetase with glutamic acid, which then is enzymatically converted to glutamrine. A post-charging conversion is also involved in selenocysteine charging via the seryl-tRNA synthetase. A similar mechanism has been proposed for asparagine charging, but has never been demonstrated (Wilcox, M.,*Eur. J. Biochem.* 11:405 (1969); Martin, N. C., et al., *J. Mol. Biol.* 101:285 (1976); Martin, N. C., et al., *Biochemistry* 16:4672 (1977); Schon, A., et al., *Biochimie* 70:391 (1988); Soll, D. and RajBhandary, U., Eds. *Am. Soc. for Microbiol.* (1995)). The inability to find homologs of the lysine and cysteine aminoacyl-tRNA synthetases is surprising because bacterial and eukaryotic versions in each instance show clear homology.

Aminoacyl-tRNA synthetases of *M. jannaschii* and other archaea resemble eukaryoticsynthetases more closely than they resemble bacterial forms. The tryptophanyl synthetase is one of the more notable examples, because the *M. jannaschii* and eukaryotic version do not appear to be specifically related to the bacterial version (de Pouplana, R., et al., *Proc. Natl. Acad. Sci., USA* 93:166 (1996)). Two versions of the glycyl synthetase are known in bacteria, one that is very unlike the version found in Archaea and Eukaryote and one that is an obvious homolog of it (Wagner, E. A., et al., *J. Bacteriol.* 177:5179 (1995); Logan, D. T., et al., *EMBO J.* 14:4156 (1995)).

Eleven genes encoding subunits of the DNA-dependent RNA polymerase were identified in the *M. jannaschii* genome. The sequence similarity between the subunits and their homologs in *Sutfolobus acidocaldarius* supports the evolutionary unity of the archaeal polymerase complex (Woese, C. R. and Wolfe, R. S., Eds. *The Bacteria, vol. VIII* (Academic Press, NY, 1985); Langer, D., et al., *Proc. Natl. Acad. Sci.* 92:5768 (1995); Lanzendoerfer, M. et al., *System. Appl. Microbiol.* 16:656 (1994)). All of the subunits found in *M. jannaschii* show greater similarity to their eukaryotic counterparts than to the bacterial homologs. The genes encoding the five largest subunits (A', A", B', B", D) have homologs in all organisms. Six genes encode subunits shared only by Archaea and Eukaryotes (E, H, K, L, and N). The *M. jannaschii* homolog of the *S. acidocaldarius* subunit E is split into two genes designated E' and E". *Sulfobus acidocaldarius* also contains two additional small subunits of RNA polymerase, designated G and F, that have no counterparts in either Bacteria or Eukaryotes. No homolog of these subunits was identified in *M. jannaschii*.

The archaeal transciption initiation system is essentially the same as that found in Eukaryotes, and is radically different from the bacterial version (Klenk, H. P. and Doolittle, W. F., *Curr. Biol.* 4.920 (1994)). The central molecules in the former systems are the TATA-binding protein (TBP) and transcription factor B (TFIIB and TFIIIB in Eukaryotes, or simply TFB). In the eukaryotic systems, TBP and TFB are parts of larger complexes, and additional factors (such as TFIIA and TFIIF) are used in the transcription process. However, the *M. jannaschii* genome does not contain obvious homologs of TFIIA and TFIIF.

Several components of the replication machinery were identified in *M. jannaschii*. The *M. jannaschii* genome appears to encode a single DNA-dependent polymerase that is a member of the B family of polymerases (Bernard, A., et al.,*EMBO J.* 6:4219 (1987); Cullman, G., et al.,*Molec. Cell Biol.* 15:4661 (1995); Uemori, T., et al., *J. Bacteriol.* 117:2164 (1995); Delarue, M., et al., *Prot. Engineer.* 3:461

(1990); Gavin, K. A., et al., *Science* 270:1667 (1995)). The polymerase shares sequence similarity and three motifs with other family B polymerases, including eukaryotic α, γ, and ε polymerases, bacterial polymerase II, and several archaeal polymerases. However, it is not homologous to bacterial polymerase I and has no homologs in *H. influenzae* or *M. genitalium*.

Primer recognition by the polymerase takes place through a structure-specific DNA binding complex, the replication factor complex (rfc) (Bernard, A., et al., *EMBO J.* 6:4219 (1987); Cullman, G., et al., *Molec. Cell Biol.* 15:4661 (1995); Uemori, T., et al., *J. Bacteriol.* 117:2164 (1995); Delarue, M., et al., *Prot. Engineer.* 3:461 (1990); Gavin, K. A., et al., *Science* 270:1667 (1995)). In humans and yeast, the rfc is composed of five proteins: a large subunit and four small subunits that have an associated adenosine triphosphatase (ATPase) activity stimulated by proliferating cell nuclear antigen (PCNA). Two genes in *M. jannaschii* are putative members of a eukaryotic-like replication factor complex. One of the genes in *M. jannaschii* is a putative homolog of the large subunit of the rfc, whereas the second is a putative homolog of one of the small subunits. Among Eukaryotes, the rfc proteins share sequence similarity in eight signature domains (Bernard, A., et al., *EMBO J.* 6:4219 (1987); Cullman, G., et al., *Molec. Cell Biol.* 15:4661 (1995); Uemori, T., et al., *J. Bacteriol.* 117:2164 (1995); Delarue, M., et al., *Prot. Engineer.* 3:461 (1990); Gavin, K. A., et al., *Science* 270:1667 (1995)). Domain I is conserved only in the large subunit among Eukaryotes and is similar in sequence to DNA ligases. This domain is missing in the large-subunit homolog in *M. jannaschii*. The remaining domains in the two *M. jannaschii* genes are well-conserved relative to the eukaryotic homologs. Two features of the sequence similarity in these domains are of particular interest. First, domain II (an ATPase domain) of the small-subunit homolog is split between two highly conserved amino acids (lysine and threonine) by an intervening sequence of unknown function. Second, the sequence of domain VI has regions that are useful for distinguishing between bacterial and eukaryotic rfc proteins (Bernard, A., et al., *EMBO J.* 6:4219 (1987); Cullman, G., et al., *Molec. Cell Biol.* 15:4661 (1995); Uemori, T., et al., *J. Bacteriol.* 117:2164 (1995); Delarue, M., et al., *Prot. Engineer.* 3:461 (1990); Gavin, K. A., et al., *Science* 270:1667 (1995)); the rfc sequence for *M. jannaschii* shares the characteristic eukaryotic signature in this domain.

We have attempted to identify an origin of replication by searching the *M. jannaschii* genome sequence with a variety of bacterial and eukaryotic replication-origin consensus sequences. Searches with oriC, ColE1, and autonomously replicating sequences from yeast (Bernard, A., et al., *EMBO J.* 6:4219 (1987); Cullman, G., et al., *Molec. Cell Biol.* 15:4661 (1995); Uemori, T., et al., *J. Bacteriol.* 117:2164 (1995); Delarue, M., et al., *Prot. Engineer.* 3:461 (1990); Gavin, K. A., et al., *Science* 270:1667 (1995)) did not identify an origin of replication. With respect to the related cellular processes of replication initiation and cell division, the *M. jannaschii* genome contains two genes that are putative homologs of Cdc54, a yeast protein that belongs to a family of putative DNA replication initiation proteins (Whitbred, L. A. and Dalton, S., *Gene* 155:113 (1995)). A third potential regulator of cell division in *M. jannaschii* is 55% similar at the amino acid level to pelota, a Drosophila protein involved in the regulation of the early phases of meiotic and mitotic cell division (Eberhart, C. G. and Wasserman, S. A., *Development* 121:3477 (1995)).

In contrast to the putative rfc complex and the initiation of DNA replication, the cell division proteins from *M. jannaschii* most resemble their bactiial counterparts (Rothfield, L. I. and Zhao, C. R., *Cell* 84:183 (1996); Lutkenhaus, J., *Curr. Opp. Gen. Devel.* 3:783 (1993)). Two genes similar to that encoding FtsZ, a ubiquitous bacterial protein, are found in *M. jannaschii*. FtsZ is a polymer-forming, guanosine triphosphate (GTP)-hydrolyzing protein with tubulin-like elements; it is localized to the site of septation and forms a constricting ring between the dividing cells. One gene similar to FtsJ, a bacterial cell division protein of undetermined function, also is found in *M. jannaschii*. Three additional genes (MinC, MinD, and MinE) function in concert in Bacteria to determine the site of septation during cell division. In *M. jannaschii*, three MinD-like genes were identified, but none for MinC or MinE. Neither spindle-associated proteins characteristic of eukaryotic cell division nor bacterial mechanocherical enzymes necessary for partitioning the condensed chromosomes were detected in the *M. jannaschii* genome. Taken together, these observations raise the possibility that cell division in *M. jannaschii* might occur via a mechanism specific for the Archaea.

The structural and functional conservation of the signal peptide of secreted proteins in Archaea, Bacteria, and Eukaryotes suggests that the basic mechanisms of membrane targeting and translocation may be similar among all three domains of life. The secretory machinery of *M. jannaschii* appears a rudimentary apparatus relative to that of bacterial and eukaryotic systems and consists of (i) a signal peptidase (SP) that cleaves the signal peptide of translocating proteins, (ii) a preprotein translocase that is the major constituent of the membrane-localized translocation channel, (iii) a ribonucleoprotein complex (signal recognition particle, SRP) that binds to the signal peptide and guides nascent proteins to the cell membrane, and (iv) a docking protein that acts as a receptor for the SRP. The 7S RNA component of the SRP from *M. jannaschii* shows a highly conserved structural domain shared by other Archaea, Bacteria, and Eukaryotes (Kaine, B. P. and Merkel, V. L., *J. Bacteriol.* 171:4261 (1989); Poritz, M. A. et al., *Cell* 55:4 (1988)). However, the predicted secondary structure of the 7S RNA SRP component in Archaea is more like that found in Eukaryotes than in Bacteria (Kaine, B. P. and Merkel, V. L., *J. Bacteriol.* 171:4261 (1989); Poritz, M. A. et al., *Cell* 55:4 (1988)). The SP and docking proteins from *M. jannaschii* are most similar to their eukaryotic counterparts; the translocase is most similar to the SecY translocation-associated protein in *Escherichia coli*.

A second distinct signal peptide is found in the flagellin genes of *M. jannaschii*. Alignment of flagellin genes from *M. voltae* (Faguy, D. M., et al., *Can. J. Microbiol.* 40:67 (1994); Kalmokoff, M. L., et al., *Arch. Microbiol.* 157:481 (1992)) and *M. jannaschii* reveals a highly conserved $NAH_2$-terminus (31 of the first 50 residues are identical in all of the mature flagellins). The peptide sequence of the *M.*

*jannaschii* flagellin indicates that the protein is cleaved after the canonical Gly-12 position, and it is proposed to be similar to type-IV pilins of Bacteria (Faguy, D. M., et al., *Can. J. Microbiol.* 40:67 (1994); Kalmokoff, M. L., et al., *Arch. Microbiol.* 157:481 (1992)).

Five histone genes are present in the *M. jannaschii* genome—three on the main chromosome and two on the large ECE. These genes are homologs of eukaryotic histones (H2a, H2b, H3, and H4) and of the eukaryotic transcription-related CAAT-binding factor CBF-A (Sandman, K., et al., *Proc. Natl. Acad. Sci. USA* 87:5788 (1990)). The similarity between archaeal and eukaryotic histones suggests that the two groups of organisms resemble one another in the roles histones play both in genome supercoiling dynamics and in gene expression. The five *M. jannaschii* histone genes show greatest similarity among themselves even though a histone sequence is available from the closely related species, *Methanococcus voltae*. This intraspecific similarity suggests that the gene duplications that produced the five histone genes occurred on the *M. jannaschii* lineage per se.

Self-splicing portions of a peptide sequence that generally encode a DNA endonuclease activity are called inteins, in analogy to introns (Kane, P. M., et al., *Science* 250:651 (1990); Hirata, R., et al., *J. Biol. Chem.* 265:6726 (1990); Cooper, A. and Stevens, T., *TIBS* 20:351 (1995); Xu, M. Q., et al., *Cell* 75:1371 (1993); Perler et al., *Proc. Natl. Acad. Sci. USA* 89:5577 (1992); Cooper et al., *EMBO J.* 225.75 (1993); Michel et al., *Biochimie* 64:867 (1992); Pietrokovski S., *Prot. Sci.* 3:2340 (1994). Most inteins in the *M. jannaschii* genome were identified by (i) similarity of the bounding exteins to other proteins, (ii) similarity of the inteins to those previously described, (iii) presence of the dodecapeptide endonuclease motifs, and (iv) canonical intein-exteinjunction sequences. In two instances (MJ0832 and MJ0043), the similarity to other database sequences did not unambiguously define the NH$_2$-terminal extein-intein junction, so it was necessary to rely on consensus sequences to select the putative site. The inteins in MJ1042 and MJ0542 have previously uricharacterized COOH-terminal splice junctions, GNC and FNC, respectively).

The sequences remaining after an intein is excised are called exteins, in analogy to exons. Exteins are spliced together after the excision of one or more inteins to form functional proteins. The biological significance and role of inteins are not clearly understood (Kane, P. M., et al., *Science* 250:651 (1990); Hirata, R., et al., *J. Biol. Chem.* 265:6726 (1990); Cooper, A. and Stevens, T., *TIBS* 20:351 (1995); Xu, M. Q., et al., *Cell* 75:1371 (1993); Perler et al., *Proc. Natl. Acad. Sci. USA* 89:5577 (1992); Cooper et al., *EMBO J.* 12:2575 (1993); Michel et al., *Biochimie* 64:867 (1992); Pietrokovski S., *Prot. Sci.* 3:2340 (1994)). Fourteen genes in the *M. jannaschii* genome contain 18 putative inteins, a significant increase in the approximately 10 intein-containing genes that have been described (Kane, P. M., et al., *Science* 250:651 (1990); Hirata, R., et al., *J. Biol. Chem.* 265:6726 (1990); Cooper, A. and Stevens, T., *TIBS* 20:351 (1995); Xu, M. Q., et al., *Cell* 75:1371 (1993); Perler et al., *Proc. Natl. Acad. Sci. USA* 89:5577 (1992); Cooper et al., *EMBO J.* 12:2575 (1993); Michel et al., *Biochimie* 64:867 (1992); Pietrokovski S., *Prot. Sci.* 3:2340 (1994)) (Table 4).

The only previously described inteins in the Archaea are in the DNA polymerase genes of the Thermococcales (Kane, P. M., et al., *Science* 250:651 (1990); Hirata, R., et al., *J. Biol. Chem.* 265:6726 (1990); Cooper, A. and Stevens, T., *TIBS* 20:351 (1995); Xu, M. Q., et al., *Cell* 75:1371 (1993); Perler et al., *Proc. Natl. Acad. Sci. USA* 89:5577 (1992); Cooper et al., *EMBO J.* 12:2575 (1993); Michel et al., *Biochimie* 64:867 (1992); Pietrokovski S., *Prot. Sci.* 3:2340 (1994)). The *M. jannaschi* DNA polymerase gene has two inteins in the same locations as those in Pyrococcus sp. strain KOD1. In this case, the exteins exhibit 46% amino acid identity, whereas intein 2 of the two organisms has only 33% identity. This divergence suggests that intein 2 has not been recently (laterally) transferred between the Thermococcales and *M. jannaschii*. In contrast, the intein 1 sequences are 56% identical, more than that of the gene containing them, and comparable to the divergence of inteins within the Thermococcales. This high degree of sequence similarity might be the result of an intein transfer more recent than the splitting of these species. The large number of inteins found in *M. jannaschii* led us to question whether these inteins have been increasing in number by moving within the genome. If this were so, we would expect to find some pairs of inteins that are particularly similar. Comparisons of these and other available intein sequences showed that the closest relationships are those noted above linking the DNA polymerase inteins to correspondingly positioned elements in the Thermococcales. Within *M. jannaschii*, the highest identity observed was 33% for a 380-bp portion of two inteins. This finding suggests that the diversification of the inteins predates the divergence of the *M. jannaschii* and Pyrococcus DNA polymerases.

Three families of repeated genetic elements were identified in the *M. jannaschii* genome. Within two of the families, at least two members were identified as ORFs with a limited degree of sequence similarity to bacterial transposases. Members of the first family, designated ISAMJ1, are repeated 10 times on the main chromosome and once on the large ECE (FIG. 5). There is no sequence similarity between the IS elements in *M. jannaschii* and the ISM1 mobile element described previously for *Methanobrevibacter smithii* (Hamilton, P. T. et al., *Mol. Gen. Genet.* 200:47 (1985)). Two members of this family were identified as ORFs and are 27% identical (at the amino acid sequence level) to a transposase from *Bacillus thuringiensis* (IS240; GenBank accession number M23741). Relative to these two members, the remaining members of the ISAMJ1 family are missing an internal region of several hundred nucleotides (FIG. 5). With one exception, all members of this family end with 16-bp terminal inverted repeats typical of insertion sequences. One member is missing the terminal repeat at its 5' end. The second family consists of two ORFs that are identical across 928 bp. The ORFs are 23% identical at the amino acid sequence level to the COOH-terminus of a transposase from *Lactococcus lactis* (IS982; GenBank accession number L34754). Neither of the members of the second family contains terminal inverted repeats.

Eighteen copies of the third family of repeated genetic structures (FIG. 6) are distributed fairly evenly around the *M. jannaschii* genome (FIG. 4). Unlike the genetic elements described above, none of the components of this repeat unit appears to have coding potential: The repeat structure is composed of a long segment followed by one to 25 tandem repetitions of a short segment. The short segments are separated by sequence that is unique within and among the complete repeat structure. Three similar types of short segments were identified; however, the type of short repeat is consistent within each repeat structure, except for variation of the last short segment in six repeat structures. Similar tandem repeats of short segments have been observed in Bacteria and other Archaea (Mojica, F. J. M., et al., *Mol. Micro.* 17:85 (1995)) and have been hypothesized to participate in chromosome partitioning during cell division.

The 16-kbp ECE from *M. jannaschii* contains 12 ORFs, none of which had a significant full-length match to any published sequence (FIG. 3). The 58-kbp ECE contains 44 predicted protein-coding regions, 5 of which had matches to genes in the database. Two of the genes are putative archaeal histones, one is a sporulation-related protein (SOJ protein), and two are type I restriction modification enzymes. There are several instances in which predicted protein-coding regions or repeated genetic elements on the large ECE have similar counterparts on the main chromosome of *M. jannaschii* (FIG. 3). The degree of nucleotide sequence similarity between genes present on both the ECE and the main chromosome ranges from 70 to 90%, suggesting that there has been relatively recent exchange of at least some genetic material between the large ECE and the main chromosome.

All the predicted protein-coding regions from *M. jannaschii* were searched against each other in order to identify families of paralogous genes (genes related by gene duplication, not speciation). The initial criterion for grouping paralogs was >30% amino acid sequence identity over 50 consecutive amino acid residues. Groups of predicted protein-coding regions were then aligned and inspected individually to ensure that the sequence similarity extended over most of their lengths. This curatorial process resulted in the identification of more than 100 gene families, half of which have no database matches. The largest identified gene family (16 members) (FIG. 7) contains almost 1% of the total predicted protein-coding regions in *M. jannaschii*.

Despite the availability for comparison of two complete bacterial genomes and several hundred megabase pairs of eukaryotic sequence data, the majority of genes in *M. jannaschii* cannot be identified on the basis of sequence similarity. Previous evidence for the shared common ancestry of the Archaeal and Eukaryotic was based on a small set gene sequences (Iwabe, N., et al., *Proc. Natl. Acad. Sci. USA* 86:9355 (1989); Gogarten J. P., et al., *Proc. Natl. Acad. Sci. USA* 86:6661 (1989); Brown, J. R. and Doolittle, W. F., *Proc. Natl. Acad. Sci. USA* 92:2441 (1995)). The complete genome of *M. jannaschii* allows us to move beyond a "gene by gene" approach to one that encompasses the larger picture of metabolic capacity and cellular systems. The anabolic genes of *M. jannaschii* (especially those related to energy production and nitrogen fixation) reveal an ancient metabolic world shared largely by Bacteria and Archaea. That many basic autotrophic pathways appear to have a common evolutionary origin suggests that the most recent universal common ancestor to all three domains of extant life had the capacity for autotrophy. The Archaea and Bacteria also share structural and organizational features that the most recent universal prokaryotic ancestors also likely possessed, such as circular genomes and genes organized as operons. In contrast, the cellular information-processing and secretion systems in *M. jannaschii* demonstrate the common ancestry of Eukaryotes and Archaea. Although there are components of these systems are present in all three domains, their apparent refinement over time-especially transcription and translation-indicate that the Archaea and Eukaryotes share a common evolutionary trajectory independent of the lineage of Bacteria.

EXAMPLE 2

Preparation of PCR Primers and Amplification of DNA

Various fragments of the *Methanococcus jannaschii* genome, such as those disclosed in Tables 2(a), 2(b) and 3 can be used, in accordance with the present invention, to prepare PCR primers. The PCR primers are preferably at least 15 bases, and more preferably at least 18 bases in length. When selecting a primer sequence, it is preferred that the primer pairs have approximately the same G/C ratio, so that melting temperatures are approximately the same. The PCR primers are useful during PCR cloning of the ORFs described herein.

EXAMPLE 3

Gene expression from DNA Sequences Corresponding to ORFs

A fragment of the *Methanococcus jannaschii* genome (preferably, a protein-encoding sequence) provided in Tables 2(a), 2(b) or 3 is introduced into an expression vector using conventional technology (techniques to transfer cloned sequences into expression vectors that direct protein translation in mammalian, yeast, insect or bacterial expression systems are well known in the art). Commercially available vectors and expression systems are available from a variety of suppliers including Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism, as explained by Hatfield et al, U.S. Pat. No. 5,082,767, which is hereby incorporated by reference.

The following is provided as one exemplary method to generate polypeptide(s) from a cloned ORF of the Methanococcus genome whose sequence is provided in SEQ ID NOS:1, 2 and 3. A poly A sequence can be added to the construct by, for example, splicing out the poly A sequence from pSGS (Stratagene) using Bg/I and Sa/I restriction endonuclease enzymes and incorporating it into the mammalian expression vector pXT1 (Stratagene) for use in eukaryotic expression systems. pXT1 contains the LTRs and a portion of the gag gene from Moloney Murine Leukemia Virus. The position of the LTRs in the construct allow efficient stable transfection. The vector includes the Herpes Simplex thymidine kinase promoter and the selectable neomycin gene. The Methanococcus DNA is obtained by PCR from the bacterial vector using oligonucleotide primers complementary to the Methanococcus DNA and containing restriction endonuclease sequences for PstI incorporated into the 5' primer and Bg/II at the 5' end of the corresponding Methanococcus DNA 3' primer, taking care to ensure that the Methanococcus DNA is positioned such that its followed with the poly A sequence. The purified fragment obtained from the resulting PCR reaction is digested with PstI, blunt ended with an exonuclease, digested with Bg/II, purified and ligated to pXT1, now containing a poly A sequence and digested Bg/II.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.). The protein is preferably released into the supernatant. However if the protein has membrane binding domains, the protein may additionally be retained within the cell or expression may be restricted to the cell surface.

Since it may be necessary to purify and locate the transfected product, synthetic 15-mer peptides synthesized from the predicted Methanococcus DNA isequence are injected into mice to generate antibody to the polypeptide encoded by the Methanococcus DNA.

If antibody production is not possible, the Methanococcus DNA sequence is additionally incorporated into eukaryotic expression vectors and expressed as a chimeric with, for example, β-globin. Antibody to β-globin is used to purify the chimeric. Corresponding protease cleavage sites engineered between the β-globin gene and the Methanococcus DNA are then used to separate the two polypeptide fragments from one another after translation. One useful expression vector for generating β-globin chimerics is pSG5 (Stratagene). This vector encodes rabbit β-globin. Intron II of the rabbit β-globin gene facilitates splicing of the expressed transcript, and the polyadenylation signal incorporated into the construct increases the level of expression. These techniques as described are well known to those skilled in the art of molecular biology. Standard methods are available from the technical assistance representatives from Stratagene, Life Technologies, Inc., or Promega. Polypeptides may additionally be produced from either construct using in vitro translation systems such as In vitro Express™ Translation Kit (Stratagene).

EXAMPLE 4

E. coli Expression of a M. jannaschii ORF and protein purification

A M. jannaschii ORF described in Table 2(a), 2(b), or 3 is selected and amplified using PCR oligonucleotide primers designed from the nucleotide sequences flanking the selected ORF and/or from portions of the ORF's $NH_2$- or COOH-terminus. Additional nucleotides containing restriction sites to facilitate cloning are added to the 5' and 3' sequences, respectively.

The restriction sites are selected to be convenient to restriction sites in the bacterial expression vector pD10 (pQE9), which is used for bacterial expression. (Qiagen, Inc. 9259 Eton Avenue, Chatsworth, Calif., 91311). [pD10]pQE9 encodes ampicillin antibiotic resistance ("Amp") and contains a bacterial origin of replication ("ori"), an IPTG inducible promoter, a ribosome binding site ("RBS"), a 6-His tag and restriction enzyme sites.

The amplified M. jannaschii DNA and the vector pQE9 both are digested with SalI and XbaI and the digested DNAs are then ligated together. Insertion of the M. jannaschii DNA into the restricted pQE9 vector places the M. jannaschii coding region downstream of and operably linked to the vector's IPTG-inducible promoter and in-frame with an initiating AUG appropriately positioned for translation of the M. jannaschii protein.

The ligation mixture is transformed into competent E. coli cells using standard procedures. Such procedures are described in Sambrook et al., Molecular Cloning: a Laboratory Manual, 2nd Ed.; Cold Spring Harbor Laboratory Press, Cold Spring Harbor, N.Y. (1989). E. coli strain M15/rep4, containing multiple copies of the plasmid pREP4, which expresses lac repressor and confers kanamycin resistance ("Kan"), is used in carrying out the illustrative example described herein. This strain, which is only one of many that are suitable for expressing M. jannaschii protein, is available commercially from Qiagen.

Transformants are identified by their ability to grow on LB plates in the presence of ampicillin and kanamycin. Plasmid DNA is isolated from resistant colonies and the identity of the cloned DNA confirmed by restriction analysis. Clones containing the desired constructs are grown overnight ("O/N") in liquid culture in LB media supplemented with both ampicillin (100 µg/ml) and kanamycin (25 µg/ml).

The O/N culture is used to inoculate a large culture, at a dilution of approximately 1:100 to 1:250. The cells are grown to an optical density at 600 nm ("OD600") of between 0.4 and 0.6. Isopropyl-B-D-thiogalactopyranoside ("IPTG") is then added to a final concentration of 1 mM to induce transcription from lac repressor sensitive promoters, by inactivating the lacI repressor. Cells subsequently are incubated further for 3 to 4 hours. Cells then are harvested by centrifugation and disrupted, by standard methods. Inclusion bodies are purified from the disrupted cells using routine collection techniques, and protein is solubilized from the inclusion bodies into 8M urea. The 8M urea solution containing the solubilized protein is passed over a PD-10 column in 2×phosphate-buffered saline ("PBS"), thereby removing the urea, exchanging the buffer and refolding the protein. The protein is purified by a further step of chromatography to remove endotoxin followed by sterile filtration. The sterile filtered protein preparation is stored in 2×PBS at a concentration of 95 µ/ml.

EXAMPLE 5

Cloning and Expression of a M. jannaschii protein in a Baculovirus 25 Expression. System A M. jannaschii ORF described in Table 2(a), 2(b), or 3 is selected and amplified as above. The amplified DNA is isolated from a 1% agarose gel using a commercially available kit ("Gene clean," BIO 101 Inc., La Jolla, Calif.). The DNA then is digested with XbaI and again purified on a 1% agarose gel. This DNA is designated herein as F2.

The vector pA2-GP is used to express the M. jannaschii protein in the baculovirus expression system as described in Summers et al., A Manual of Methods for Baculovirus Vectors and Insect Cell Culture Procedures, Texas Agricultural Experimental Station Bulletin No. 1555 (1987). The pA2-GP expression vector contains the strong polyhedrin promoter of the *Autographa californica* nuclear polyhedrosis virus (AcMNPV) followed by convenient restriction sites. The signal peptide of AcMNPV gp67, including the N-terminal methionine, is located just upstream of a BamHI site. The polyadenylation site from the simian virus 40 ("SV40") is used for efficient polyadenylation. For an easy selection of recombinant virus, the beta-galactosidase gene from *E. coli* is inserted in the same orientation as the polyhedrin promoter and is followed by the polyadenylation signal of the polyhedrin gene. The polyhedrin sequences are flanked at both sides by viral sequences for cell-mediated homologous recombination with wild-type viral DNA to generate viable virus that express the cloned polynucleotide.

Many other baculovirus vectors could be used in place of pA2-GP, such as pAc373, pVL941 and pAcIMI provided, as those of skill readily will appreciate, that construction provides appropriately located signals for transcription, translation, trafficking and the like, such as an in-frame AUG and a signal peptide, as required. Such vectors are described in Luckow et al., *Virology* 170: 31–39, among others.

The plasmid is digested with the restriction enzyme XbaI and then is dephosphorylated using calf intestinal phosphatase, using routine procedures known in the art. The DNA is then isolated from a 1% agarose gel using a commercially available kit ("Geneclean" BIO 101 Inc., La Jolla, Calif.). This vector DNA is designated herein "V".

Fragment F2 and the dephosphorylated plasmid V2 are ligated together with T4 DNA ligase. *E. coli* HB101 cells are transformed with ligation mix and spread on culture plates. Bacteria are identified that contain the plasmid with the *M. jannaschii* gene by digesting DNA from individual colonies using XbaI and then analyzing the digestion product by gel electrophoresis. The sequence of the cloned fragment is confirmed by DNA sequencing. This plasmid is designated herein pBac*M. jannaschii*.

5 µg of the plasmid pBac*M. jannaschii* is co-transfected with 1.0 µg of a commercially available linearized baculovirus DNA ("BaculoGold™ baculovirus DNA", Phanningen, San Diego, Calif.), using the lipofection method described by Felgner et al., *Proc. Natl. Acad. Sci. USA* 84: 7413–7417 (1987). 1 µg of BaculoGold™ virus DNA and 5 µg of the plasmid pBac*M. jannaschii* are mixed in a sterile well of a microtiter plate containing 50 µl of serum-free Grace's medium (Life Technologies Inc., Gaithersburg, Md.). Afterwards 10 µl Lipofectin plus 90 µl Grace's medium are added, mixed and incubated for 15 minutes at room temperature. Then the transfection mixture is added drop-wise to Sf9 insect cells (ATCC CRL 1711) seeded in a 35 mm tissue culture plate with 1 ml Grace's medium without serum. The plate is rocked back and forth to mix the newly added solution. The plate is then incubated for 5 hours at 27° C. After 5 hours the transfection solution is removed from the plate and 1 ml of Grace's insect medium supplemented with 10% fetal calf serum is added. The plate is put back into an incubator and cultivation is continued at 27° C. for four days.

After four days the supernatant is collected and a plaque assay is performed, as described by Summers and Smith, cited above. An agarose gel with "Blue Gal" (Life Technologies Inc., Gaithersburg) is used to allow easy identification and isolation of gal-expressing clones, which produce blue-stained plaques. (A detailed description of a "plaque assay" of this type can also be found in the user's guide for insect cell culture and baculovirology distributed by Life Technologies Inc., Gaithersburg, page 9–10).

Four days after serial dilution, the virus is added to the cells. After appropriate incubation, blue stained plaques are picked with the tip of an Eppendorf pipette. The agar containing the recombinant viruses is then resuspended in an Eppendorf tube containing 200 µl of Grace's medium. The agar is removed by a brief centrifugation and the supernatant containing the recombinant baculovirus is used to infect Sf9 cells seeded in 35 mm dishes. Four days later the supernatant of these culture dishes are harvested and then they are stored at 4° C. A clone containing properly inserted hESSB I, II and III is identified by DNA analysis including restriction mapping and sequencing. This is designated herein as V-*M. jannaschii*.

Sf9 cells are grown in Grace's medium supplemented with 10% heat-inactivated FBS. The cells are infected with the recombinant baculovirus V-*M. jannaschii* at a multiplicity of infection ("MOI") of about 2 (about 1 to about 3). Six hours later the medium is removed and is replaced with SF900 II medium minus methionine and cysteine (available from Life Technologies Inc., Gaithersburg). 42 hours later, 5 µCi of $^{35}$S-methionine and 5 µCi $^{35}$S-cysteine (available from Amersham) are added. The cells are further incubated for 16 hours and then they are harvested by centrifugation, lysed and the labeled proteins are visualized by SDS-PAGE and autoradiography.

EXAMPLE 6

Cloning and Expression in Mammalian Cells

Most of the vectors used for the transient expression of a *M. jannaschii* gene in mammalian cells should carry the SV40 origin of replication. This allows the replication of the vector to high copy numbers in cells (e.g., COS cells) which express the T antigen required for the initiation of viral DNA synthesis. Any other mammalian cell line can also be utilized for this purpose.

A typical mammalian expression vector contains the promoter element, which mediates the initiation of transcription of mRNA, the protein-coding sequence, and signals required for the termination of trancription and polyadenylation of the transcript. Additional elements include enhancers, Kozak sequences and intervening sequences flanked by donor and acceptor sites for RNA splicing. Highly efficient transcription can be achieved with the early and late promoters from SV40, the long terminal repeats (LTRs) from Retroviruses, e.g., RSV, HTLVI, HIVI and the early promoter of the cytomegalovirus (CMV). However, cellular signals can also be used (e.g., human actin promoter). Suitable expression vectors for use in practicing the present invention include, for example, vectors such as pSVL and pMSG (Pharmacia, Uppsala, Sweden), pRSVcat (ATCC 37152), pSV2dhfr (ATCC 37146) and pBC12MI (ATCC 67109). Mammalian host cells that could be used include, human Hela, 283, H9 and Jurkat cells, mouse NIH3T3 and C127 cells, Cos 1, Cos 7 and CV1, African green monkey cells, quail QC1–3 cells, mouse L cells and Chinese hamster ovary cells.

Alternatively, the gene can be expressed in stable cell lines that contain the gene integrated into a chromosome. The co-transfection with a selectable marker such as dhfr, gpt, neomycin, hygromycin allows the identification and isolation of the transfected cells.

The transfected gene can also be amplified to express large amounts of the encoded protein. The DHFR (dihydrofolate reductase) is a useful marker to develop cell lines that carry several hundred or even several thousand copies of the gene of interest. Another useful selection marker is the enzyme glutamine synthase (GS) (Murphy et al., Biochem J. 227:277–279 (1991); Bebbington et al., Bio/Technology 10:169–175 (1992)). Using these markers, the mammalian cells are grown in selective medium and the cells with the highest resistance are selected. These cell lines contain the amplified genes(s) integrated into a chromosome. Chinese hamster ovary (CHO) cells are often used for the production of proteins.

The expression vectors pC1 and pC4 contain the strong promoter (LTR) of the Rous Sarcoma Virus (Cullen et al, Molecular and Cellular Biology, 438–447 (March, 1985)) plus a fragment of the CMV-enhancer (Boshart et al., Cell 41:521–530 (1985)). Multiple cloning sites, e.g., with the restriction enzyme cleavage sites BamHI, XbaI and Asp718, facilitate the cloning of the gene of interest. The vectors contain in addition the 3' intron, the polyadenylation and termination signal of the rat preproinsulin gene.

EXAMPLE 6(a)

Cloning and Expression in COS Cells

The expression plasmid, pM. jannaschii HA, is made by cloning a cDNA encoding a M. jannaschii protein into the expression vector pcDNAI/Amp (which can be obtained from Invitrogen, Inc.).

The expression vector pcDNAI/amp contains: (1) an E. coli origin of replication effective for propagation in E. coli and other prokaryotic cells; (2) an ampicillin resistance gene for selection of plasmid-containing prokaryotic cells; (3) an SV40 origin of replication for propagation in eukaryotic cells; (4) a CMV promoter, a polylinker, an SV40 intron, and a polyadenylation signal arranged so that a cDNA conveniently can be placed under expression control of the CMV promoter and operably linked to the SV40 intron and the polyadenylation signal by means of restriction sites in the polylinker.

A DNA fragment encoding the M. jannaschii protein and an HA tag fused in frame to its 3' end is cloned into the polylinker region of the vector so that recombinant protein expression is directed by the CMV promoter. The HA tag corresponds to an epitope derived from the influenza hemagglutinin protein described by Wilson et al., Cell 37: 767 (1984). The fusion of the HA tag to the target protein allows easy detection of the recombinant protein with an antibody that recognizes the HA epitope.

The PCR amplified DNA fragment (generated as described above) and the vector, pcDNAI/Amp, are digested with HindIII and XhoI and then ligated. The ligation mixture is transformed into E. coli strain SURE (available from Stratagene Cloning Systems, 11099 North Torrey Pines Road, La Jolla, Calif. 92037), and the transformed culture is plated on ampicillin media plates which then are incubated to allow growth of ampicillin resistant colonies. Plasmid DNA is isolated from resistant colonies and examined by restriction analysis and gel sizing for the presence of the M. jannaschii protein-encoding fragment.

For expression of recombinant M. jannaschii, COS cells are transfected with an expression vector, as described above, using DEAE-DEXTRAN, as described, for instance, in Sambrook et al., Molecular Cloning: a Laboratory Manual, Cold Spring Laboratory Press, Cold Spring Harbor, N.Y. (1989). Cells are incubated under conditions for expression of M. jannaschii protein by the vector.

Expression of the M. jannaschii HA fusion protein is detected by radiolabelling and immunoprecipitation, using methods described in, for example Harlow et al., Antibodies: A Laboratory Manual, 2nd Ed.; Cold Spring Harbor Laboratory Press, Cold Spring Harbor, N.Y. (1988). To this end, two days after transfection, the cells are labeled by incubation in media containing $^{35}$S-cysteine for 8 hours. The cells and the media are collected, and the cells are washed and the lysed with detergent-containing RIPA buffer: 150 mM NaCl, 1% NP-40, 0.1% SDS, 1% NP40, 0.5% DOC, 50 mM TRIS, pH 7.5, as described by Wilson et al. cited above. Proteins are precipitated from the cell lysate and from the culture media using an HA-specific monoclonal antibody. The precipitated proteins then are analyzed by SDS-PAGE gels and autoradiography. An expression product of the expected size is seen in the cell lysate, which is not seen in negative controls.

EXAMPLE 6(b)

Cloning and Expression in CHO Cells

The vector pC1 is used for the expression of a M. jannaschii protein. —Plasmid pC1 is a derivative of the plasmid pSV2-dhfr [ATCC Accession No. 37146]. Both plasmids contain the mouse DHFR gene under control of the SV40 early promoter. Chinese hamster ovary- or other cells lacking dihydrofolate activity that are transfected with these plasmids can be selected by growing the cells in a selective medium (alpha minus MEM, Life Technologies) supplemented with the chemotherapeutic agent methotrexate. The amplification of the DHFR genes in cells resistant to methotrexate (MTX) has been well documented (see, e.g., Alt, F. W., Kellems, R. M., Bertino, J. R., and Schirnke, R. T., 1978, J. Biol. Chem. 253:1357–1370, Hamlin, J. L. and Ma, C. 1990, Biochem. et Biophys. Acta, 1097:107–143, Page, M. J. and Sydenham, M. A. 1991, Biotechnology Vol. 9:64–68). Cells grown in increasing concentrations of MTX develop resistance to the drug by overproducing the target enzyme, DHFR, as a result of amplification of the DHFR gene. If a second gene is linked to the DHFR gene it is usually co-amplified and over-expressed. It is state of the art to develop cell lines carrying more than 1,000 copies of the genes. Subsequently, when the methotrexate is withdrawn, cell lines contain the amplified gene integrated into the chromosome(s).

Plasmid pC1 contains for the expression of the gene of interest a strong promoter of the long terminal repeat (LTR)

of the Rouse Sarcoma Virus (Cullen, et al., Molecular and Cellular Biology, March 1985:4384470) plus a fragment isolated from the enhancer of the immediate early gene of human cytomegalovirus (CMV) (Boshart et al., *Cell* 41:521–530, 1985). Downstream of the promoter are the following single restriction enzyme cleavage sites that allow the integration of the genes: BamHI, PvuII, and NruI. Behind these cloning sites the plasmid contains translational stop codons in all three reading flames followed by the 3' intron and the polyadenylation site of the rat preproinsulin gene. Other high efficient promoters can also be used for the expression, e.g., the human β-actin promoter, the SV40 early or late promoters or the long terminal repeats from other retroviruses, e.g., HIV and HTLVI. For the polyadenylation of the mRNA other signals, e.g., from the human growth hormone or globin genes can be used as well.

Stable cell lines carrying the gene of interest integrated into the chromosomes can also be selected upon co-transfection with a selectable marker such as gpt, G418 or hygromycin. It is advantageous to use more than one selectable marker in the beginning, e.g., G418 plus methotrexate.

The plasmid pC1 is digested with the restriction enzyme BamHI and then dephosphorylated using calf intestinal phosphates by procedures known in the art. The vector is then isolated from a 1% agarose gel.

The *M. jannaschii* protein-encoding sequence is is amplified using PCR oligonucleotide primers as described above. An efficient signal for initiation of translation in eukaryotic cells, as described by Kozak, M., J. Mol. Biol. 196:947–950 (1987) is appropriately located in the vector portion of the construct. The amplified fragments are isolated from a 1% agarose gel as described above and then digested with the endonucleases BamHI and Asp718 and then purified again on a 1% agarose gel.

The isolated fragment and the dephosphorylated vector are then ligated with T4 DNA ligase. *E. coli* HB101 cells are then transformed and bacteria identified that contained the plasmid pC1 inserted in the correct orientation using the restriction enzyme BamHI. The sequence of the inserted gene is confirmed by DNA sequencing.

Transfection of CHO-DHFR-cells

Chinese hamster ovary cells lacking an active DHFR enzyme are used for transfection. 5 µg of the expression plasmid C1 are cotransfected with 0.5 µg of the plasmid pSVneo using the lipofecting method (Felgner et al., supra). The plasmid pSV2-neo contains a dominant selectable marker, the gene neo from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) and cultivated from 10–14 days. After this period, single clones are trypsinized and then seeded in 6-well petri dishes using different concentrations of methotrexate (25 nM, 50 nM, 100 nM, 200 nM, 400 nM). Clones growing at the highest concentrations of methotrexate are then transferred to new 6-well plates containing even higher concentrations of methotrexate (500 nM, 1 µM, 2 µM, 5 µM). The same procedure is repeated until clones grow at a concentration of 100 µM.

The expression of the desired gene product is analyzed by Western blot analysis and SDS-PAGE.

EXAMPLE 7

Production of an Antibody to a *Methanococcus jannaschii* Protein

Substantially pure *M. jannaschii* protein or polypeptide is isolated from the transfected or transformed cells described above using an art-known method. The protein can also be chemically synthesized. Concentration of protein in the final preparation is adjusted, for example, by concentration on an Amicon filter device, to the level of a few micrograms/ml. Monoclonal or polyclonal antibody to the protein can then be prepared as follows:

Monoclonal Antibody Production by Hybridoma Fusion

Monoclonal antibody to epitopes of any of the peptides identified and isolated as described can be prepared from murine hybridomas according to the -classical method of Kohler, G. and Milstein, C., *Nature* 256:495 (1975) or modifications of the methods thereof. Briefly, a mouse is repetitively inoculated with a few micrograms of the selected protein over a period of a few weeks. The mouse is then sacrificed, and the antibody producing cells of the spleen isolated. The spleen cells are fused by means of polyethylene glycol with mouse myeloma cells, and the excess unfused cells destroyed by growth of the'system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., *Meth. Enzymol.* 70:419 (1980), and modified methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2 (1989).

Polyclonal Antibody Production by Immunization

Polyclonal antiserum containing antibodies to heterogenous epitopes of a single protein can be prepared by immunizing suitable animals with the expressed protein described above, which can be unmodified or modified to enhance immunogenicity. Effective polyclonal antibody production is affected by many factors related both to the antigen and the host species. For example, small molecules tend to be less immunogenic than other molecules and may require the use of carriers and adjuvant. Also, host animals vary in response to site of inoculations and dose, with both inadequate or excessive doses of antigen resulting in low titer antisera Small doses (ng level) of antigen administered at multiple intradermal sites appears to be most reliable. An effective immunization protocol for rabbits can be found in Vaitukaitis, J. et al., *J. Clin. Endocrinol. Metab.* 33:988–991 (1971).

Booster injections can be given at regular intervals, and antiserum harvested when antibody titer thereof, as determined semi-quantitatively, for example, by double immunodiffusion in agar against known concentrations of the antigen, begins to fall (See Ouchterlony, O. et al., Chap. 19 in: *Handbook of Experimental Immunology*, Wier, D., ed, Blackwell (1973)). Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: *Manual of Clinical Immunology*, second edition, Rose and Friedman, (eds.), Amer. Soc. For Microbio., Washington, D.C. (1980).

Antibody preparations prepared according to either protocol are useful in quantitative immunoassays which determine concentrations of antigen-bearing substances in biological samples; they are also used semi-quantitatively or qualitatively to identify the presence of antigen in a biological sample.

TABLE 1A

Amino acid biosynthesis

Aromatic amino acid family

| | | | | | | |
|---|---|---|---|---|---|---|
| MJ1454 | 47830 | 48390 | 3-dehydroquinate dehydratase {*Escherichia coli*} | 32.6 | 54.0 | 561 |
| MJ0502 | 1029204 | 1027915 | 5-enolpyruvylshikimate 3-phosphate synthase {*Haemophilus influenzae*} | 38.2 | 60.0 | 1290 |
| MJ1075 | 456842 | 458158 | anthranilate synthase, subunit I {*Clostridium thermocellum*} | 52.7 | 72.1 | 1317 |
| MJ0234 | 1247181 | 1246243 | anthranilate synthase, subunit II' {*Thermotoga maritima*} | 44.1 | 64.3 | 939 |
| MJ0238 | 1242410 | 1241916 | anthranilate synthase, subunit II" {*Thermotoga maritima*} | 52.6 | 75.0 | 495 |
| MJ0246 | 1238364 | 1238660 | chorismate mutase subunit A {*Erwinia herbicola*} | 37.4 | 59.4 | 297 |
| MJ0612 | 929781 | 928723 | chorismate mutase subunit B {*Escherichia coli*} | 33.2 | 56.2 | 1059 |
| MJ1175 | 357469 | 358572 | chorismate synthase {Synechocystis sp} | 48.8 | 66.5 | 1104 |
| MJ0918 | 621924 | 622682 | indole-3-glycerol phosphate synthase {*Halobacterium volcanii*} | 42.7 | 67.7 | 759 |
| MJ0451 | 1068501 | 1067845 | N-phosphoribosyl anthranilate isomerase {*Haloferax volcanii*} | 41.9 | 62.5 | 657 |
| MJ0637 | 904569 | 905264 | prephenate dehydratase {*Lactococcus lactis*} | 39.3 | 61.7 | 696 |
| MJ1084 | 449533 | 448757 | shikimate 5-dehydrogenase {*Escherichia coli*} | 38.9 | 57.4 | 777 |
| MJ1038 | 502619 | 501777 | tryptophan synthase, subunit alpha {*Methanobacterium thermoautotrophicum*} | 49.8 | 69.3 | 843 |
| MJ1037 | 503929 | 502808 | tryptophan synthase, subunit beta {*Acinetobacter calcoaceticus*} | 62.2 | 78.7 | 1122 |

Aspartate family

| | | | | | | |
|---|---|---|---|---|---|---|
| MJ1116 | 414120 | 415679 | asparagine synthetase {*Escherichia coli*} | 34.0 | 54.3 | 1560 |
| MJ1056 | 476613 | 476170 | asparagine synthetase {*Bacillus subtilis*} | 33.0 | 54.6 | 444 |
| MJ1391 | 132691 | 133833 | aspartate aminotransferase {*Sulfolobus solfataricus*} | 31.0 | 52.2 | 1143 |
| MJ0684 | 859565 | 860632 | aspartate aminotransferase {*Sulfolobus solfataricus*} | 37.8 | 63.1 | 1068 |
| MJ0001 | 1469369 | 1470142 | aspartate aminotransferase {*Sulfolobus solfataricus*} | 39.2 | 63.8 | 774 |
| MJ0205 | 1273947 | 1274951 | aspartate-semialdehyde dehydrogenase {*Leptospira interrogans*} | 50.4 | 67.2 | 1005 |
| MJ0571 | 963902 | 962544 | aspartokinase I {*Serratia marcescens*} | 37.0 | 56.7 | 1359 |
| MJ1473 | 26812 | 27558 | cobalamin-independent methionine synthase {*Methanobacterium thermoautotrophicum*} | 47.7 | 65.3 | 747 |
| MJ1097 | 433957 | 435159 | diaminopimelate decarboxylase {*Haemophilus influenzae*} | 43.2 | 66.6 | 1203 |
| MJ1119 | 412913 | 412029 | diaminopimelate epimerase {*Haemophilus influenzae*} | 36.2 | 56.6 | 885 |
| MJ0422 | 1090629 | 1091441 | dihydrodipicolinate reductase {*Haemophilus influenzae*} | 45.0 | 64.4 | 813 |
| MJ0244 | 1239093 | 1239776 | dihydrodipicolinate synthase {*Haemophilus influenzae*} | 46.6 | 64.4 | 684 |
| MJ1003 | 540278 | 539106 | homoaconitase {*Saccharomyces cerevisiae*} | 35.7 | 56.9 | 1173 |
| MJ1602 | 1563296 | 1562289 | homoserine dehydrogenase {*Bacillus subtilis*} | 40.4 | 63.2 | 1008 |
| MJ1104 | 427241 | 428128 | homoserine kinase {*Haemophilus influenzae*} | 30.1 | 53.9 | 888 |
| MJ0020 | 1450056 | 1451210 | L-asparaginase I {*Haemophilus influenzae*} | 34.8 | 53.1 | 1155 |
| MJ0457 | 1064285 | 1063176 | succinyl-diaminopimelate desuccinylase {*Haemophilus influenzae*} | 27.0 | 45.8 | 1110 |
| MJ1465 | 36982 | 38157 | threoninesynthase {*Bacillus subtilis*} | 51.2 | 71.1 | 1176 |

Glutamate family

| | | | | | | |
|---|---|---|---|---|---|---|
| MJ0069 | 1406333 | 1405455 | acetylglutamate kinase {*Bacillus stearothermophilus*} | 44.4 | 65.7 | 879 |
| MJ0791 | 757315 | 758637 | argininosuccinate lyase {*Campylobacter jejuni*} | 41.3 | 65.6 | 1323 |
| MJ0429 | 1087105 | 1086023 | argininosuccinate synthase {*Methanococcus vannielii*} | 70.2 | 86.8 | 1083 |
| MJ0186 | 1287178 | 1288140 | glutamate N-acetyltransferase {*Bacillus stearothermophilus*} | 47.4 | 63.1 | 963 |
| MJ1351 | 172535 | 174007 | glutamate synthase (NADPH), subunit alpha {*Escherichia coli*} | 40.5 | 54.0 | 1473 |
| MJ1346 | 179417 | 178068 | glutamine synthetase {*Methanococcus voltae*} | 70.5 | 84.7 | 1350 |
| MJ1096 | 435486 | 436508 | N-acetyl gamma-glutamyl-phosphate reductase {*Bacillus subtilis*} | 40.4 | 63.6 | 1023 |
| MJ0721 | 817148 | 816045 | N-acetylornithine aminotransferase {Anabaena sp.} | 46.7 | 67.0 | 1104 |
| MJ0881 | 664952 | 665845 | ornithine carbamoyltransferase {*Halobacterium halobium*} | 43.0 | 69.6 | 894 |

Pyruvate family

| | | | | | | |
|---|---|---|---|---|---|---|
| MJ0503 | 1027812 | 1026610 | 2-isopropylmalate synthase {*Lactococcus lactis*} | 44.4 | 61.1 | 1203 |
| MJ1392 | 131826 | 130633 | 2-isopropylmalate synthase {Anabaena sp.} | 43.0 | 63.1 | 1194 |
| MJ1271 | 256614 | 256216 | 3-isopropylmalate dehydratase {*Salmonella typhimurium*} | 44.1 | 62.0 | 399 |
| MJ1277 | 249421 | 249807 | 3-isopropylmalate dehydratase {*Clostridium pasteurianum*} | 49.5 | 70.2 | 387 |
| MJ0663 | 884580 | 883129 | acetolactate synthase, large subunit {*Porphyra umbilicalis*} | 34.5 | 54.6 | 1452 |
| MJ0277 | 1207735 | 1209507 | acetolactate synthase, large subunit {*Bacillus subtilis*} | 50.2 | 69.7 | 1773 |
| MJ0161 | 1307199 | 1307702 | acetolactate synthase, small subunit {*Bacillus subtilis*} | 49.4 | 74.1 | 504 |
| MJ1008 | 533323 | 534132 | branched-chain amino acid aminotransferase {*Escherichia coli*} | 42.6 | 59.0 | 810 |
| MJ1276 | 250052 | 251710 | dihydroxy-acid dehydratase {*Lactococcus lactis*} | 44.6 | 65.1 | 1659 |
| MJ1195 | 333450 | 335003 | isopropylmalate synthase {*Haemophilus influenzae*} | 42.9 | 63.7 | 1554 |
| MJ1543 | 1615932 | 1614931 | ketol-acid reductoisomerase {*Bacillus subtilis*} | 53.7 | 77.0 | 1002 |

Serine family

| | | | | | | |
|---|---|---|---|---|---|---|
| MJ1597 | 1568671 | 1567445 | glycine hydroxymethyltransferase {*Methanobacterium thermoautotrophicum*} | 69.8 | 80.7 | 1227 |
| MJ1018 | 523454 | 524806 | phosphoglycerate dehydrogenase {*Bacillus subtilis*} | 42.7 | 65.4 | 1353 |

TABLE 1A-continued

| | | | | | | |
|---|---|---|---|---|---|---|
| MJ1594 | 1571545 | 1571039 | phosphoserine phosphatase {*Haemophilus influenzae*} | 40.4 | 62.7 | 507 |
| MJ0959 | 580672 | 581778 | serine aminotransferase {*Methanobacterium thermoformicicum*} | 54.5 | 74.9 | 1107 |
| Histidine family | | | | | | |
| MJ1204 | 324063 | 324878 | ATP phosphoribosyltransferase {*Escherichia coli*} | 34.0 | 57.3 | 816 |
| MJ1456 | 46532 | 45354 | histidinol dehydrogenase {*Lactococcus lactis*} | 47.6 | 67.5 | 1179 |
| MJ0955 | 586179 | 585073 | histidinol-phosphate aminotransferase {*Bacillus subtilis*} | 37.7 | 60.8 | 1107 |
| MJ0698 | 848921 | 848364 | imidazoleglycerol-phosphate dehydrogenase {*Methanobacterium thermoautotrophicum*} | 51.7 | 71.2 | 558 |
| MJ0506 | 1024803 | 1025237 | imidazoleglycerol-phosphate synthase (amidotransferase) {*Lactococcus lactis*} | 45.6 | 62.1 | 435 |
| MJ0411 | 1101451 | 1100636 | imidazoleglycerol-phosphate synthase (cyclase) {*Azospirillum brasilense*} | 61.5 | 78.8 | 816 |
| MJ1430 | 71328 | 71047 | phosphoribosyl AMP cyclohydrolase {*Methanococcus vannielii*} | 70.0 | 86.3 | 282 |
| MJ0302 | 1186990 | 1187208 | phosphoribosyl-ATP pyrophosphohydrolase {*Azotobacter chroococcum*} | 54.1 | 68.9 | 219 |
| MJ1532 | 1628155 | 1627745 | phosphoribosylformimino-5-aminoimidazole carboxamide ribotide isomerase {*Methanococcus thermolithotrophicus*} | 51.9 | 81.1 | 411 |
| Biosynthesis of cofactors, prosthetic groups, and carriers | | | | | | |
| MJ0603 | 937289 | 938566 | glutamate-1-semialdehyde aminotransferase {*Bacillus subtilis*} | 51.7 | 70.6 | 1278 |
| MJ0569 | 966316 | 967137 | porphobilinogen deaminase {*Bacillus subtilis*} | 41.2 | 61.4 | 822 |
| MJ0493 | 1035991 | 1036839 | quinolinate phosphoribosyltransferase {*Escherichia coli*} | 39.3 | 61.6 | 849 |
| MJ0407 | 1105699 | 1104965 | quinolinate synthetase {*Cyanophora paradoxa*} | 37.2 | 58.8 | 735 |
| MJ1388 | 136484 | 135309 | S-adenosylhomocysteine hydrolase {*Sulfolobus solfataricus*} | 61.7 | 78.5 | 1176 |
| Biotin | | | | | | |
| MJ1297 | 227704 | 227021 | 6-carboxyhexanoate-CoA ligase {*Bacillus sphaericus*} | 42.2 | 62.2 | 684 |
| MJ1298 | 227005 | 225890 | 8-amino-7-oxononanoate synthase {*Bacillus sphaericus*} | 44.4 | 64.8 | 1116 |
| MJ1300 | 225025 | 223709 | adenosylmethionine-8-amino-7-oxononanoate aminotransferase {*Bacillus sphaericus*} | 39.9 | 64.2 | 1317 |
| MJ1619 | 1543130 | 1543552 | bifunctional protein {*Haemophilus influenzae*} | 25.7 | 54.9 | 423 |
| MJ1296 | 228286 | 228843 | biotin synthetase {*Bacillus sphaericus*} | 38.2 | 62.5 | 558 |
| MJ1299 | 225741 | 225100 | dethiobiotin synthetase {*Bacillus sphaericus*} | 37.0 | 59.0 | 642 |
| Heme and porphyrin | | | | | | |
| MJ1438 | 66330 | 65833 | cobalamin (5'-phosphate) synthase {*Escherichia coli*} | 26.1 | 48.7 | 498 |
| MJ0552 | 983686 | 984417 | cobalamin biosynthesis J protein {*Salmonella typhimurium*} | 26.7 | 51.2 | 732 |
| MJ1314 | 212528 | 211842 | cobalamin biosynthesis protein D {*Pseudomonas denitrificans*} | 38.0 | 61.0 | 687 |
| MJ0022 | 1448163 | 1447273 | cobalamin biosynthesis protein D {*Salmonella typhimurium*} | 35.5 | 61.1 | 891 |
| MJ1569 | 1592308 | 1591700 | cobalamin biosynthesis protein M {*Salmonella typhimurium*} | 29.5 | 54.7 | 609 |
| MJ1091 | 442661 | 443239 | cobalamin biosynthesis protein M {*Salmonella typhimurium*} | 53.7 | 74.4 | 579 |
| MJ0908 | 635150 | 631647 | cobalamin biosynthesis protein N {*Pseudomonas denitrificans*} | 37.5 | 57.6 | 3504 |
| MJ0484 | 1046784 | 1045324 | cobyric acid synthase {*Methanococcus voltae*} | 73.7 | 89.8 | 1461 |
| MJ1421 | 85381 | 86352 | cobyrinic acid a,c-diamide synthase {*Salmonella typhimurium*} | 32.1 | 55.0 | 972 |
| MJ0143 | 1332080 | 1330965 | glutamyl-tRNA reductase {*Methanobacterium thermoautotrophicum*} | 47.8 | 66.9 | 1116 |
| MJ0643 | 899800 | 898910 | porphobilinogen synthase {*Methanothermus sociabilis*} | 62.5 | 79.9 | 891 |
| MJ0930 | 612059 | 611430 | precorrin isomerase {*Salmonella typhimurium*} | 38.7 | 62.0 | 630 |
| MJ0771 | 780420 | 779932 | precorrin-2 methyltransferase {*Salmonella typhimurium*} | 30.4 | 55.9 | 489 |
| MJ0813 | 734876 | 735547 | precorrin-3 methylase {*Salmonella typhimurium*} | 44.2 | 68.4 | 672 |
| MJ1578 | 1583277 | 1582501 | precorrin-3 methylase {*Salmonella typhimurium*} | 54.6 | 76.5 | 777 |
| MJ1522 | 1637017 | 1636385 | precorrin-6Y methylase {*Salmonella typhimurium*} | 30.6 | 52.3 | 633 |
| MJ0391 | 1116729 | 1117202 | precorrin-8W decarboxylase {*Salmonella typhimurium*} | 23.9 | 49.1 | 474 |
| MJ0965 | 573234 | 572509 | uroporphyrin-III C-methyltransferase {*Bacillus megaterium*} | 54.7 | 72.5 | 726 |
| MJ0994 | 549022 | 549444 | uroporphyrinogen III synthase {*Bacillus subtilis*} | 27.8 | 49.4 | 423 |
| Menaquinone and ubiquinone | | | | | | |
| MJ1645 | 1509624 | 1508923 | coenzyme PQQ synthesis protein III {*Haemophilus influenzae*} | 32.2 | 53.3 | 702 |
| Molybdopterin | | | | | | |
| MJ0824 | 725986 | 726762 | molybdenum cofactor biosynthesis moaA protein {*Haemophilus influenzae*} | 30.0 | 57.3 | 777 |
| MJ0167 | 1301836 | 1302162 | molybdenum cofactor biosynthesis moaB protein {*Escherichia coli*} | 46.4 | 69.6 | 327 |
| MJ1135 | 396359 | 396781 | molybdenum cofactor biosynthesis moaC protein {*Haemophilus influenzae*} | 49.2 | 70.9 | 423 |
| MJ0886 | 654158 | 656017 | molybdenum cofactor biosynthesis moeA protein {*Escherichia coli*} | 34.5 | 55.2 | 1860 |
| MJ0666 | 879771 | 880943 | molybdenum cofactor biosynthesis moeA protein {*Haemophiius influenzae*} | 33.6 | 56.4 | 1173 |
| MJ1663 | 1491265 | 1490831 | molybdopterin-guanine dinucleotide biosynthesis protein A {*Escherichia coli*} | 27.7 | 48.0 | 435 |
| MJ1324 | 197777 | 197076 | molybdopterin-guanine dinucleotide biosynthesis protein B {*Escherichia coli*} | 32.2 | 57.7 | 702 |
| Pantothenate | | | | | | |
| MJ0913 | 626982 | 627779 | pantothenate metabolism flavoprotein {*Haemophilus influenzae*} | 34.1 | 55.7 | 798 |
| Riboflavin | | | | | | |
| MJ0055 | 1416688 | 1417278 | GTP cyclohydrolase II {*Bacillus subtilis*} | 35.8 | 56.0 | 591 |
| MJ0671 | 874773 | 875396 | riboflavin-specific deaminase {*Actinobacillus pleuropneumoniae*} | 43.0 | 65.3 | 624 |
| Thioredoxin, glutaredoxin, and glutathione | | | | | | |
| MJ1536 | 1622694 | 1623533 | thioredoxin reductase {*Mycoplasma genitalium*} | 38.5 | 58.0 | 840 |
| MJ0530 | 1005917 | 1005420 | thioredoxin-2 {*Saccharomyces cerevisiae*} | 33.0 | 63.3 | 498 |
| MJ0307 | 1184114 | 1184332 | thioredoxin/glutaredoxin {*Methanobacterium thermoautotrophicum*} | 48.7 | 69.5 | 219 |

TABLE 1A-continued

Thiamine

| | | | | | | |
|---|---|---|---|---|---|---|
| MJ1026 | 514172 | 515440 | thiamine biosynthesis protein {*Bacillus subtilis*} | 45.0 | 66.1 | 1269 |
| MJ0601 | 940113 | 939400 | thiamine biosynthetic enzyme {*Zea mays*} | 35.1 | 53.0 | 714 |

Pyridine nucleotides

| | | | | | | |
|---|---|---|---|---|---|---|
| MJ1352 | 170567 | 171163 | NH(3)-dependent NAD+ synthetase {*Mycoplasma genitalium*} | 47.5 | 63.8 | 597 |

Cell envelope

Membranes, lipoproteins, and porins

| | | | | | | |
|---|---|---|---|---|---|---|
| MJ0544 | 989805 | 990443 | dolichyl-phosphate mannose synthase {*Trypanosoma brucei*} | 35.1 | 57.1 | 639 |
| MJ1057 | 475508 | 474981 | glycosyl transferase {*Neisseria gonorrhoeae*} | 25.8 | 50.0 | 528 |
| MJ0611 | 931098 | 930679 | membrane protein {Saccharum sp.} | 50.0 | 57.2 | 420 |
| MJ0827 | 724322 | 723900 | membrane protein {*Homo sapiens*} | 44.9 | 67.0 | 423 |

Murein sacculus and peptidoglycan

| | | | | | | |
|---|---|---|---|---|---|---|
| MJ1160 | 371691 | 370390 | amidase {*Moraxella catarrhalis*} | 24.6 | 36.1 | 1302 |
| MJ0204 | 1276277 | 1275219 | amidophosphoribosyltransferase {*Bacillus subtillis*} | 52.0 | 72.9 | 1059 |

Surface polysaccharides, lipopolysaccharides and antigens

| | | | | | | |
|---|---|---|---|---|---|---|
| MJ0924 | 617598 | 618035 | capsular polysaccharide biosynthesis protein {*Staphylococcus aureus*} | 31.3 | 46.9 | 438 |
| MJ1061 | 469649 | 470293 | capsular polysaccharide biosynthesis protein D {*Staphylococcus aureus*} | 56.3 | 72.2 | 645 |
| MJ1055 | 478643 | 477735 | capsular polysaccharide biosynthesis protein I {*Staphylococcus aureus*} | 50.7 | 74.4 | 909 |
| MJ1059 | 472326 | 471904 | capsular polysaccharide biosynthsis protein M {*Staphylococcus aureus*} | 34.4 | 55.0 | 423 |
| MJ1607 | 1555624 | 1554455 | LPS biosynthesis related rfbu-protein {*Haemophilus influenzae*} | 33.4 | 57.6 | 1170 |
| MJ1113 | 417528 | 418352 | N-acetylglucosamine-1-phosphate transferase {*Sulfolobus acidocaldarius*} | 29.9 | 57.9 | 825 |
| MJ0399 | 1110873 | 1112204 | phosphomannomutase {*Vibrio cholerae*} | 37.0 | 57.8 | 1332 |
| MJ1068 | 462901 | 464265 | putative O-antigen transporter {*Shigella flexneri*} | 24.5 | 46.6 | 1365 |
| MJ1066 | 464369 | 465430 | spore coat polysaccharide biosynthesis protein C {*Bacillus subtillis*} | 55.3 | 75.8 | 1062 |
| MJ1065 | 465444 | 466454 | spore coat polysaccharide biosynthesis protein E {*Bacillus subtilis*} | 37.9 | 59.0 | 1011 |
| MJ1063 | 467331 | 467828 | spore coat polysaccharide biosynthesis protein F {*Bacillus subtillis*} | 36.0 | 55.4 | 498 |
| MJ1062 | 467870 | 469279 | spore coat polysaccharide biosynthesis protein G {*Bacillus subtillis*} | 32.0 | 54.5 | 1410 |
| MJ0211 | 1269601 | 1268732 | UDP-glucose 4-epimerase {*Streptococcus thermophilus*} | 35.1 | 54.8 | 870 |
| MJ1054 | 481027 | 478712 | UDP-glucose dehydrogenase {*Xanthomonas campestris*} | 42.8 | 63.4 | 2316 |
| MJ0428 | 1087456 | 1088655 | UDP-N-acetyl-D-mannosaminuronic acid dehydrogenase {*Escherichia coli*} | 45.1 | 68.2 | 1200 |

Surface structures

| | | | | | | |
|---|---|---|---|---|---|---|
| MJ0891 | 650616 | 650005 | flagellin 31 {*Methanococcus voltae*} | 55.4 | 71.6 | 612 |
| MJ0892 | 649880 | 649269 | flagellin 32 {*Methanococcus voltae*} | 61.1 | 78.4 | 612 |
| MJ0893 | 649163 | 648516 | flagellin 33 {*Methanococcus voltae*} | 59.1 | 78.7 | 648 |

Cellular processes

Cell division

| | | | | | | |
|---|---|---|---|---|---|---|
| MJ1489 | 10595 | 8721 | cell division control protein {*Saccharomyces cerevisiae*} | 34.8 | 57.7 | 1875 |
| MJ0363 | 1142460 | 1140220 | cell division control protein 21 {*Schizosaccharomyces pombe*} | 30.0 | 51.4 | 2241 |
| MJ1156 | 375317 | 377947 | cell division control protein CDC48 {*Saccharomyces cerevisiae*} | 51.9 | 71.7 | 2631 |
| MJ0169 | 1300988 | 1300329 | cell division inhibitor {*Bacillus subtillis*} | 28.8 | 51.2 | 660 |
| MJ0579 | 957291 | 958088 | cell division inhibitor {*Bacillus subtillis*} | 31.8 | 53.2 | 798 |
| MJ0547 | 988025 | 988732 | cell division inhibitor {*Bacillus subtillis*} | 32.8 | 57.7 | 708 |
| MJ0084 | 1393471 | 1392869 | cell division inhibitor minD {*Escherichia coli*} | 32.1 | 50.4 | 603 |
| MJ0174 | 1295971 | 1294976 | cell division protein {*Drosophila melanogaster*} | 28.4 | 54.6 | 996 |
| MJ0370 | 1135876 | 1134956 | cell division protein ftsZ {Anabaena 7120} | 50.7 | 71.7 | 921 |
| MJ1376 | 147975 | 147343 | cell division protein J {*Haemophilus influenzae*} | 39.8 | 58.5 | 633 |
| MJ0622 | 920029 | 921168 | cell division protein Z {*Haloferax volcanii*} | 51.0 | 71.7 | 1140 |
| MJ0148 | 1326798 | 1327538 | centromere/microtubule-binding protein {*Saccharomyces cerevisiae*} | 42.7 | 64.7 | 741 |
| MJ1647 | 1508164 | 1507907 | DNA binding protein {*Methanococcus voltae*} | 54.7 | 80.3 | 258 |
| MJ1643 | 1513857 | 1510351 | P115 protein {*Mycoplasma hyorhinis*} | 30.3 | 55.4 | 3507 |

Chaperones

| | | | | | | |
|---|---|---|---|---|---|---|
| MJ0999 | 543921 | 545471 | chaperonin {*Methanopyrus kandleri*} | 73.5 | 87.6 | 1551 |
| MJ0285 | 1202058 | 1202459 | heat shock protein {*Clostridium acetobutylicum*} | 29.0 | 44.6 | 402 |
| MJ0278 | 1207276 | 1207548 | rotamase, peptidyl-prolyl cis-trans isomerase {*Haemophilus influenzae*} | 40.7 | 60.5 | 273 |
| MJ0825 | 725091 | 725765 | rotamase, peptidyl-prolyl cis-trans isomerase {*Pseudomonas fluorescens*} | 31.8 | 60.8 | 675 |

Detoxification

| | | | | | | |
|---|---|---|---|---|---|---|
| MJ0736 | 804803 | 805453 | alkyl hydroperoxide reductase {*Sulfolobus solfataricus*} | 66.1 | 84.8 | 651 |
| MJ1541 | 1618786 | 1619868 | N-ethylammeline chlorohydrolase {*Rhodococcus rubropertinctus*} | 29.2 | 56.3 | 1083 |

Protein and peptide secretion

| | | | | | | |
|---|---|---|---|---|---|---|
| MJ0478 | 1051985 | 1056078 | preprotein translocase secY {*Methanococcus vannielii*} | 70.9 | 88.8 | 1308 |
| MJ0111 | 1365253 | 1364216 | protein-export membrane protein {*Streptomyces coelicolor*} | 25.9 | 51.7 | 1038 |
| MJ1253 | 276673 | 277377 | protein-export membrane protein {*Escherichia coli*} | 30.5 | 57.0 | 705 |
| MJ0260 | 1226090 | 1226644 | signal peptidase {*Canis familiaris*} | 32.6 | 54.5 | 555 |
| MJ0101 | 1376106 | 1377308 | signal recognition particle protein {*Haemophilus influenzae*} | 42.0 | 61.6 | 1203 |
| MJ0291 | 1198470 | 1197244 | signal recognition particle protein {*Sulfolobus acidocaldarius*} | 48.3 | 69.4 | 1227 |

TABLE 1A-continued

Transformation

| | | | | | | |
|---|---|---|---|---|---|---|
| MJ0781 | 768702 | 770798 | klbA protein {Plasmid RK2} | 34.6 | 54.9 | 2097 |
| MJ0940 | 602402 | 601929 | transformation sensitive protein {Homo sapiens} | 35.0 | 53.9 | 474 |

Cellular processes

| | | | | | | |
|---|---|---|---|---|---|---|
| MJECL17 | 20110 | 19889 | archaeal histone {Pyrococcus sp.} | 58.8 | 81.0 | 221 |
| MJECL29 | 36456 | 26220 | archaeal histone {Pyrococcus sp.} | 64.2 | 83.6 | 236 |
| MJ1258 | 271686 | 271486 | archaeal histone {Pyrococcus sp.} | 71.7 | 83.6 | 201 |
| MJ0168 | 1301348 | 1301548 | archaeal histone {Pyrococcus sp.} | 67.2 | 86.6 | 201 |
| MJ0932 | 610153 | 609953 | archaeal histone {Pyrococcus sp.} | 67.2 | 86.6 | 201 |

Central intermediary metabolism

Amino sugars

| | | | | | | |
|---|---|---|---|---|---|---|
| MJ1420 | 90244 | 86939 | glutamine-fructose-6-phosphate transaminase {Escherichia coli} | 41.2 | 61.5 | 3306 |

Degradation of polysaccharides

| | | | | | | |
|---|---|---|---|---|---|---|
| MJ1611 | 1550816 | 1549542 | alpha-amylase {Pyrococcus furiosus} | 27.0 | 50.5 | 1275 |
| MJ0555 | 981500 | 980529 | endoglucanase {Homo sapiens} | 44.1 | 66.8 | 972 |
| MJ1610 | 1551992 | 1550967 | glucoamylase {Clostridium sp} | 28.0 | 49.2 | 1026 |

Other

| | | | | | | |
|---|---|---|---|---|---|---|
| MJ1656 | 1498675 | 1497965 | 2-hydroxyhepta-2,4-diene-1,7-dioate isomerase {Escherichia coli} | 40.2 | 61.6 | 711 |
| MJ0406 | 1106800 | 1105907 | ribokinase {Escherichia coli} | 23.2 | 46.3 | 894 |
| MJ0309 | 1182259 | 1183077 | ureohydrolase {Methanothermus fervidus} | 40.9 | 60.7 | 819 |

Phosphorus compounds

| | | | | | | |
|---|---|---|---|---|---|---|
| MJ0963 | 575418 | 577049 | N-methylhydantoinase {Arthrobacter sp.} | 32.6 | 53.0 | 1632 |
| MJ0964 | 573516 | 575345 | N-methylhydantoinase {Arthrobacter sp.} | 37.7 | 56.4 | 1830 |

Polyamine biosynthesis

| | | | | | | |
|---|---|---|---|---|---|---|
| MJ0535 | 1001006 | 1002031 | acetylpolyamine aminohydrolase {D01044 Mycoplana} | 33.3 | 48.6 | 1026 |
| MJ0313 | 1179250 | 1179801 | spermidine synthase {Homo sapiens} | 32.3 | 57.7 | 552 |

Polysaccharides-(cytoplasmic)

| | | | | | | |
|---|---|---|---|---|---|---|
| MJ1606 | 1555858 | 1551354 | glycogen synthase {Hordeum vulgare} | 33.7 | 58.3 | 1497 |

Nitrogen metabolism

| | | | | | | |
|---|---|---|---|---|---|---|
| MJ1187 | 345237 | 344335 | ADP-ribosylglycohydrolase (draG) {Rhodospirillum rubrum} | 29.8 | 50.8 | 903 |
| MJ0713 | 824113 | 826278 | hydrogenase accessory protein {Azotobacter chroococcum} | 33.8 | 54.8 | 2166 |
| MJ0214 | 1267658 | 1267314 | hydrogenase accessory protein {Azotobacter chroococcum} | 30.7 | 56.5 | 345 |
| MJ0676 | 869311 | 870276 | hydrogenase expression/formation protein {Rhizobium leguminosarum} | 46.1 | 65.3 | 966 |
| MJ0442 | 1075480 | 1076028 | hydrogenase expression/formation protein B {Rhizobium leguminosarum} | 44.6 | 64.0 | 549 |
| MJ0200 | 1279494 | 1279739 | hydrogenase expression/formation protein C {Azotobacter vinelandii} | 40.0 | 68.8 | 246 |
| MJ0993 | 549539 | 550525 | hydrogenase expression/formation protein D {Alcaligenes eutrophus} | 44.7 | 63.5 | 987 |
| MJ0631 | 914544 | 914089 | hydrogenase maturation protease {Escherichia coli} | 33.9 | 58.9 | 456 |
| MJ1093 | 441468 | 440584 | nifB protein {Anabaena sp} | 43.1 | 67.2 | 885 |
| MJ0879 | 667622 | 666984 | nitrogenase reductase {Methanococcus voltae} | 77.2 | 89.1 | 639 |
| MJ0685 | 859442 | 858696 | nitrogenase reductase related protein {Clostridium pasteurianum} | 31.7 | 49.6 | 747 |
| MJ1051 | 483344 | 484411 | nodulation factor production protein {Bradyrhizobium japonicum} | 32.1 | 51.1 | 1068 |
| MJ1058 | 473947 | 473141 | nodulation factor production protein {Bradyrhizobium japonicum} | 37.7 | 58.0 | 807 |

Carbon Fixation

| | | | | | | |
|---|---|---|---|---|---|---|
| MJ0152 | 1325036 | 1322820 | carbon monoxide dehydrogenase, alpha subunit {Clostridium thermoaceticum} | 42.1 | 65.6 | 2217 |
| MJ0153 | 1322553 | 1320256 | carbon monoxide dehydrogenase, alpha subunit {Methanothrix soehngenii} | 47.9 | 67.3 | 2298 |
| MJ0156 | 1319256 | 1317883 | carbon monoxide dehydrogenase, alpha subunit {Clostridium thermoaceticum} | 47.8 | 69.5 | 1374 |
| MJ0728 | 809951 | 811783 | carbon monoxide dehydrogenase, beta subunit {Rhodospirillum rubrum} | 35.9 | 55.0 | 1833 |
| MJ0112 | 1362285 | 1363667 | corrinoid/iron sulfur protein, large subunit {Clostridium thermoaceticum} | 32.9 | 55.1 | 1383 |
| MJ0113 | 1361128 | 1362030 | corrinoid/iron sulfur protein, small subunit {Clostridium thermoaceticum} | 37.7 | 58.8 | 903 |
| MJ1235 | 292453 | 293673 | ribulose bisphosphate carboxylase, large subunit {Synechococcus sp} | 42.4 | 60.3 | 1221 |

Energy metabolism

Aerobic

| | | | | | | |
|---|---|---|---|---|---|---|
| MJ0649 | 896262 | 894919 | NADH oxidase {Enterococcus faecalis} | 28.0 | 50.4 | 1344 |
| MJ0520 | 1011104 | 1011892 | NADH-ubiquinone oxidoreductase, subunit 1 {Paracentrotus lividus} | 29.5 | 53.9 | 789 |

Anaerobic

| | | | | | | |
|---|---|---|---|---|---|---|
| MJ0092 | 1385748 | 1384282 | fumarate reductase {Thermoplasma acidophilum} | 40.2 | 57.0 | 1467 |

ATP-proton motive force interconversion

| | | | | | | |
|---|---|---|---|---|---|---|
| MJ0217 | 1263468 | 1265171 | ATP synthase, subunit A {Enterococcus hirae} | 60.3 | 76.6 | 1704 |
| MJ0216 | 1265356 | 1266615 | ATP synthase, subunit B {Methanosarcina barkeri} | 69.4 | 84.5 | 1260 |
| MJ0219 | 1261985 | 1263040 | ATP synthase, subunit C {Haloferax volcanii} | 28.1 | 50.0 | 1056 |
| MJ0615 | 926124 | 926663 | ATP synthase, subunit D {Enterococcus hirae} | 34.8 | 56.8 | 540 |
| MJ0220 | 1261297 | 1261737 | ATP synthase, subunit E {Methanosarcina mazeii} | 29.0 | 50.0 | 441 |

TABLE 1A-continued

| | | | | | | |
|---|---|---|---|---|---|---|
| MJ0218 | 1263054 | 1263347 | ATP synthase, subunit F {*Haloferax volcanii*} | 21.5 | 52.1 | 294 |
| MJ0222 | 1258252 | 1260294 | ATP synthase, subunit I {*Enterococcus hirae*} | 27.6 | 52.2 | 2043 |
| MJ0221 | 1260641 | 1261060 | ATP synthase, subunit K {*Enterococcus hirae*} | 34.6 | 59.8 | 420 |
| Electron transport | | | | | | |
| MJ1446 | 57416 | 56646 | cytochrome-c3 hydrogenase, gamma chain {*Pyrococcus furiosus*} | 40.1 | 52.4 | 771 |
| MJ0741 | 803000 | 803320 | desulfoferrodoxin {*Desulfovibrio vulgaris*} | 44.0 | 59.4 | 321 |
| MJ0578 | 958094 | 958900 | ferredoxin {*Clostridium sticklandii*} | 49.1 | 56.9 | 807 |
| MJ0061 | 1411998 | 1411759 | ferredoxin {*Methanococcus thermolithotrophicus*} | 42.9 | 59.0 | 240 |
| MJ0722 | 815808 | 816038 | ferredoxin {*Methanobacterium thermoautotrophicum*} | 42.3 | 60.6 | 231 |
| MJ0099 | 1379076 | 1379456 | ferredoxin {*Desulfovibrio desulfuricans*} | 40.0 | 62.0 | 381 |
| MJ0199 | 1279976 | 1279791 | ferredoxin {*Methanococcus thermolithotrophicus*} | 74.6 | 84.8 | 186 |
| MJ0533 | 1003408 | 1003575 | ferredoxin 2[4Fe—4S] homolog {*Methanosarcina thermophila*} | 36.9 | 54.4 | 168 |
| MJ0624 | 918981 | 918808 | ferredoxin 2[4Fe=4S] {*Methanosarcina thermophila*} | 48.0 | 68.0 | 174 |
| MJ0267 | 1217567 | 1218463 | ferredoxin oxidoreductase, alpha subunit {*Klebsiella pneumoniae*} | 29.4 | 50.2 | 897 |
| MJ0276 | 1209645 | 1210727 | ferredoxin oxidoreductase, alpha subunit {*Halobacterium halobium*} | 44.5 | 63.0 | 1083 |
| MJ0266 | 1218644 | 1219387 | ferredoxin oxidoreductase, beta subunit {*Klebsiella pneumoniae*} | 32.6 | 51.0 | 744 |
| MJ0537 | 998693 | 999424 | ferredoxin oxidoreductase, beta subunit {*Halobacteriuin halobiuin*} | 41.3 | 61.1 | 732 |
| MJ0268 | 1217015 | 1217272 | ferredoxin oxidoreductase, delta subunit {*Pyrococcus furiosus*} | 58.9 | 71.8 | 258 |
| MJ0536 | 999441 | 999980 | ferredoxin oxidoreductase, gamma subunit {*Pyrococcus furiosus*} | 32.0 | 50.9 | 540 |
| MJ0269 | 1216601 | 1216993 | ferredoxin oxidoreductase, gamma subunit {*Pyrococcus furiosus*} | 55.6 | 74.7 | 393 |
| MJ0732 | 806970 | 808100 | flavoprotein {*Methanobacterium thermoautotrophicum*} | 40.4 | 62.3 | 1131 |
| MJ1192 | 339066 | 338095 | methylviologen-reducing hydrogenase, alpha chain {*Methanococcus voltae*} | 75.0 | 88.6 | 972 |
| MJ1191 | 340221 | 339385 | methylviologen-reducing hydrogenase, gamma chain {*Methanococcus voltae*} | 71.5 | 83.3 | 837 |
| MJ1362 | 160414 | 161055 | NADH deydrogenase, subunit 1 {*Mitochondrion Oncorhynchus*} | 23.1 | 50.0 | 642 |
| MJ0514 | 1016474 | 1017223 | polyferredoxin {*Methanococcus voltae*} | 36.7 | 52.5 | 750 |
| MJ0934 | 608147 | 607521 | polyferredoxin {*Methanothermus fervidus*} | 40.9 | 54.3 | 627 |
| MJ1303 | 220214 | 221701 | polyferredoxin {*Methanobacterium thermoautotrophicum*} | 39.5 | 56.1 | 1488 |
| MJ1193 | 337655 | 336591 | polyferredoxin {*Methanococcus voltae*} | 61.7 | 74.5 | 1065 |
| MJ1227 | 301853 | 301257 | pyruvate formate-lyase activating enzyme {*Clostridium pasteurianum*} | 31.4 | 50.0 | 597 |
| MJ0735 | 805546 | 805785 | rubredoxin {*Clostridium thermosaccharolyticum*} | 59.7 | 77.0 | 240 |
| MJ0740 | 803522 | 803659 | rubredoxin {*Clostridium thermosaccharolyticum*} | 64.5 | 84.5 | 138 |
| Fermentation | | | | | | |
| MJ0007 | 1463447 | 1462359 | 2-hydroxyglutaryl-CoA dehydratase, subunit beta {*Acidaminococcus fermentans*} | 22.6 | 48.2 | 1089 |
| Gluconeogenesis | | | | | | |
| MJ1479 | 22527 | 21358 | alanine aminotransferase 2 {*Panicum miliaceum*} | 30.1 | 50.0 | 1170 |
| MJ0542 | 991264 | 994794 | phosphoenolpyruvate synthase {*Pyrococcus furiosus*} | 60.3 | 78.3 | 3531 |
| Glycolysis | | | | | | |
| MJ1482 | 18946 | 18044 | 2-phosphoglycerate kinase {*Methanothermus fervidus*} | 47.1 | 70.9 | 903 |
| MJ0641 | 901393 | 902325 | 3-phosphoglycerate kinase {*Methanothermus fervidus*} | 58.2 | 78.1 | 933 |
| MJ0232 | 1248239 | 1249432 | enolase {*Bacillus subtilis*} | 57.7 | 78.2 | 1194 |
| MJ1605 | 1557395 | 1558597 | glucose-6-phosphate isomerase {*Bacillus stearothermophilus*} | 32.3 | 54.6 | 1203 |
| MJ1146 | 386093 | 387055 | glyceraldehyde 3-phosphate dehydrogenase {*Methanothermus fervidus*} | 59.5 | 77.6 | 963 |
| MJ0490 | 1038560 | 1037697 | lactate dehydrogenase {*Thermotoga maritima*} | 39.9 | 63.2 | 864 |
| MJ1411 | 100555 | 99167 | NADP-dependent glyceraldehyde-3-phosphate dehydrogenase {L15191 Streptococcus} | 39.2 | 59.6 | 1389 |
| MJ0108 | 1367951 | 1366716 | pyruvate, kinase {*Bacillus stearothermophilus*} | 39.1 | 60.5 | 1236 |
| MJ1528 | 1631071 | 1631589 | triosephosphate isomerase {*Mycoplasma genitalium*} | 29.0 | 49.1 | 519 |
| Pentose phosphate pathway | | | | | | |
| MJ0680 | 865484 | 866083 | pentose-5-phosphate-3-epimerase {*Solanum tuberosum*} | 44.2 | 62.5 | 600 |
| MJ1603 | 1560724 | 1560047 | ribose 5-phosphate isomerase {*Mus musculus*} | 42.0 | 63.4 | 678 |
| MJ0960 | 580121 | 580576 | transaldolase {*Bacillus subtilis*} | 60.7 | 79.5 | 456 |
| MJ0681 | 864603 | 865355 | transketolase' {*Homo sapiens*} | 43.7 | 58.5 | 753 |
| MJ0679 | 866375 | 867073 | transketolase" {*Homo sapiens*} | 36.0 | 61.3 | 699 |
| Pyruvate dehydrogenase | | | | | | |
| MJ0636 | 906464 | 905292 | dihydrolipoamide dehydrogenase {*Haloferax volcanii*} | 28.9 | 51.0 | 1173 |
| Sugars | | | | | | |
| MJ1418 | 91211 | 90669 | fuculose-1-phosphate aldolase {*Haemophilus influenzae*} | 29.1 | 48.7 | 543 |
| TCA cycle | | | | | | |
| MJ0499 | 1031331 | 1032530 | aconitase {*Saccharomyces cerevisiae*} | 29.7 | 49.8 | 1200 |
| MJ1294 | 229770 | 230381 | fumarate hydratase, class I' {*Bacillus stearothermophilus*} | 35.1 | 55.7 | 612 |
| MJ0617 | 925239 | 924778 | fumarate hydratase, class I" {*Bacillus stearothermophilus*} | 43.8 | 66.0 | 462 |
| MJ1596 | 1568967 | 1569998 | isocitrate dehydrogenase {*Thermus aquaticus*} | 42.9 | 61.4 | 1032 |
| MJ0720 | 817433 | 818431 | isocitrate dehydrogenase (NADP) {*Thermus aquaticus*} | 48.0 | 64.7 | 999 |
| MJ1425 | 77051 | 76299 | malate dehydrogenase {*Methanothermus fervidus*} | 61.3 | 77.6 | 753 |
| MJ0033 | 1438609 | 1437116 | succinate dehydrogenase, flavoprotein subunit {*Escherichia coli*} | 41.8 | 58.1 | 1494 |
| MJ1246 | 282664 | 283449 | succinyl-CoA synthetase, alpha subunit {*Escherichia coli*} | 59.6 | 74.8 | 786 |
| MJ0210 | 1271318 | 1270227 | succinyl-CoA synthetase, beta subunit {*Thermus aquaticus*} | 48.8 | 68.7 | 1092 |
| Methanogenesis | | | | | | |
| MJ0253 | 1232773 | 1232405 | 8-hydroxy-5-deazaflavin-reducing hydrogenase, delta subunit {*Methanobacterium thermoautotrophicum*} | 47.1 | 71.0 | 369 |

TABLE 1A-continued

| MJ1035 | 505234 | 506022 | coenzyme F420-dependent N5,N10-methylene-tetrahydromethanopterin dehydrogenase {*Methanobacterium thermoautotrophicum*} | 66.5 | 79.8 | 789 |
|---|---|---|---|---|---|---|
| MJ0727 | 811895 | 812725 | coenzyme F420-reducing hydrogenase, alpha subunit {*Methanobacterium thermoautotrophicum*} | 26.8 | 45.8 | 831 |
| MJ0029 | 1442517 | 1441279 | coenzyme F420-reducing hydrogenase, alpha subunit {*Methanococcus voltae*} | 50.3 | 66.1 | 1239 |
| MJ0030 | 1441022 | 1440558 | coenzyme F420-reducing hydrogenase, alpha subunit {*Methanococcus voltae*} | 66.5 | 83.3 | 465 |
| MJ1349 | 175566 | 176222 | coenzyme F420-reducing hydrogenase, beta subunit {*Methanococcus voltae*} | 36.6 | 55.7 | 657 |
| MJ0725 | 813779 | 814453 | coenzyme F420-reducing hydrogenase, beta subunit {*Methanobacterium thermoautotrophicum*} | 41.0 | 62.0 | 675 |
| MJ0870 | 677657 | 679372 | coenzyme, F420-reducing hydrogenase, beta subunit {*Methanobacterium thermoautotrophicum*} | 42.7 | 63.2 | 1716 |
| MJ0032 | 1439835 | 1438990 | coenzyme F420-reducing hydrogenase, beta subunit {*Methanococcus voltae*} | 72.0 | 85.5 | 846 |
| MJ0726 | 812987 | 813499 | coenzyme F420-reducing hydrogenase, gamma subunit {*Methanococcus voltae*} | 42.7 | 59.4 | 513 |
| MJ0031 | 1440505 | 1439873 | coenzyme F420-reducing hydrogenase, gamma subunit {*Methanococcus voltae*} | 75.5 | 87.3 | 633 |
| MJ0295 | 1192687 | 1193304 | formate dehydrogenase (fdhD) {*Wolinella succinogenes*} | 35.6 | 57.7 | 618 |
| MJ0006 | 1463887 | 1465020 | formate dehydrogenase, alpha subunit {*Methanobacterium formicicum*} | 41.6 | 61.1 | 1134 |
| MJ1353 | 168767 | 170344 | formate dehydrogenase, alpha subunit {*Methanobacterium formicicum*} | 54.2 | 70.9 | 1578 |
| MJ0005 | 1465405 | 1466247 | formate dehydrogenase, beta subunit {*Methanobacterium formicicum*} | 49.5 | 72.1 | 843 |
| MJ0155 | 1319767 | 1319315 | formate dehydrogenase, iron-sulfur subunit {*Wolinella succinogenes*} | 41.7 | 56.9 | 453 |
| MJ0264 | 1220122 | 1220433 | formate hydrogenlyase, subunit 2 {*Escherichia coli*} | 42.9 | 59.8 | 312 |
| MJ0265 | 1219502 | 1219930 | formate hydrogenlyase, subunit 2 {*Escherichia coli*} | 45.5 | 61.0 | 429 |
| MJ0515 | 1013710 | 1014735 | formate hydrogenlyase, subunit 5 {*Escherichia coli*} | 31.0 | 51.1 | 1026 |
| MJ1027 | 514001 | 512871 | formate hydrogenlyase, subunit 5 {*Escherichia coli*} | 34.3 | 53.3 | 1131 |
| MJ1363 | 159614 | 160018 | formate hydrogenlyase, subunit 7 {*Escherichia coli*} | 38.4 | 60.9 | 405 |
| MJ0516 | 1013157 | 1013600 | formate hydrogenlyase, subunit 7 {*Escherichia coli*} | 48.8 | 65.6 | 444 |
| MJ0318 | 1175065 | 1175823 | formylmethanofuran:tetrahydromethanopterin formyltransferase {*Methanobacterium thermoautotrophicum*} | 68.6 | 84.5 | 759 |
| MJ1338 | 185930 | 185007 | H(2)-dependent methylenetetrahydromethanopterin dehydrogenase related protein {*Methanobacterium thermoautotrophicum*} | 29.1 | 50.5 | 924 |
| MJ0715 | 823334 | 822423 | H2-forming N5,N10-methylene-tetrahydromethanopterin dehydrogenase-related protein {*Methanococcus voltae*} | 29.9 | 52.5 | 912 |
| MJ0784 | 765279 | 764272 | H2-forming N5,N10-methylene-tetrahydromethanopterin dehydrogenease {*Methanococcus voltae*} | 73.6 | 85.5 | 1008 |
| MJ1190 | 342199 | 341003 | heterodisulfide reductase, subunit A {*Methanobacterium thermoautotrophicum*} | 58.0 | 75.2 | 1197 |
| MJ0743 | 801736 | 802422 | heterodisulfide reductase, subunit B {*Methandbacterium thermoautotrophicum*} | 59.3 | 79.0 | 687 |
| MJ0863 | 684944 | 685798 | heterodisulfide reductase, subunit B {*Methanobacterium thermoautotrophicum*} | 63.2 | 80.2 | 855 |
| MJ0744 | 801103 | 801489 | heterodisulfide reductase, subunit C {*Methanobacterium thermoautotrophicum*} | 53.4 | 68.4 | 387 |
| MJ0864 | 684283 | 684840 | heterodisulfide reductase, subunit C {*Methanobacterium thermoautotrophicum*} | 52.6 | 69.9 | 558 |
| MJ0118 | 1357167 | 1356667 | methyl coenzyme M reductase II operon, protein D {*Methanothermus fervidus*} | 53.2 | 77.5 | 501 |
| MJ0083 | 1395319 | 1393880 | methyl coenzyme M reductase II, alpha subunit {*Methanothermus fervidus*} | 89.8 | 95.5 | 1440 |
| MJ0081 | 1397700 | 1396351 | methyl coenzyme M reductase II, beta subunit {*Methanothermus fervidus*} | 79.7 | 89.4 | 1350 |
| MJ0082 | 1396335 | 1395538 | methyl coenzyme M reductase II, gamma subunit {*Methanothermus fervidus*} | 83.0 | 92.1 | 798 |
| MJ0844 | 702037 | 701465 | methyl coenzyme M reductase operon, protein C {*Methanococcus vannielii*} | 82.5 | 92.6 | 573 |
| MJ0843 | 702395 | 702069 | methyl coenzyme M reductase operon, protein D {*Methanococcus voltae*} | 58.0 | 81.4 | 327 |
| MJ1662 | 1491537 | 1493201 | methyl coenzyme M reductase system, component A2 {*Methanobacterium thermoauotrophicum*} | 37.1 | 60.1 | 1665 |
| MJ1242 | 284878 | 286338 | methyl coenzyme M reductase system, component A2 {*Methanobacterium thermoautotrophicum*} | 60.9 | 77.8 | 1461 |
| MJ0846 | 700322 | 698880 | methyl coenzyme M reductase, alpha subunit {*Methanococcus voltae*} | 86.1 | 92.1 | 1443 |
| MJ0842 | 703907 | 702576 | methyl coenzyme M reductase, beta subunit {*Methanococcus vannielii*} | 75.3 | 87.4 | 1332 |
| MJ0845 | 701389 | 700673 | methyl coenzyme M reductase, gamma subunit {*Methanococcus vannielii*} | 78.7 | 91.3 | 717 |
| MJ1636 | 1520054 | 1519128 | N5,N10-methenyl-tetrahydromethanopterin cyclohydrolase {*Methanobacterium thermdautotrophicum*} | 69.6 | 82.3 | 927 |
| MJ1534 | 1625526 | 1624534 | N5,N10-methylene tetrahydromethanopterin reductase {*Methanobacterium thermoautotrophicum*} | 66.2 | 79.7 | 993 |
| MJ0850 | 696203 | 695895 | N5-methyl-tetrahydromethanopterin:coenzyme M methyltransferase {*Methanobacterium thermoautotrophicum*} | 36.6 | 59.8 | 309 |
| MJ0849 | 696884 | 696216 | N5-methyl-tetrahydromethanopterin:coenzyme M methyltransferase {*Methanobacterium thermoautotrophicum*} | 41.8 | 62.3 | 669 |
| MJ0852 | 695117 | 694914 | N5-methyl-tetrahydromethanopterin:coenzyme M methyltransferase {*Methanobacterium thermoautotrophicum*} | 37.1 | 64.6 | 204 |
| MJ0851 | 695866 | 695138 | N5-methyl-tetrahydromethanopterin:coenzyme M methyltransferase {*Methanobacterium thermoautotrophicum*} | 55.2 | 73.5 | 729 |
| MJ0847 | 698519 | 697749 | N5-methyl-tetrahydromethanopterin:coenzyme M methyltransferase {*Methanobacterium thermoautotrophicum*} | 58.3 | 76.4 | 771 |
| MJ0854 | 694607 | 693651 | N5-methyl-tetrahydromethanopterin:coenzyme M methyltransferase {*Methanobacterium thermoautotrophicum*} | 62.1 | 77.5 | 957 |
| MJ0848 | 697696 | 697043 | N5-methyl-tetrahydromethanopterin:coenzyme M methyltransferase {*Methanobacterium thermoautotrophicum*} | 63.5 | 77.8 | 654 |
| MJ0853 | 694857 | 694639 | N5-methyl-tetrahydromethanopterin:coenzyme M methyltransferase G {*Methanobacterium thermoautotrophicum*} | 51.1 | 76.6 | 219 |
| MJ1169 | 363822 | 362122 | tungsten formylmethanofuran dehydrogenase, subunit A {*Methanobacterium thermoautotrophicum*} | 69.4 | 81.5 | 1701 |
| MJ1194 | 336096 | 335260 | tungsten formylmethanofuran dehydrogenase, subunit B {*Methanobacterium thermoautotrophicum*} | 71.1 | 84.0 | 837 |
| MJ1171 | 361740 | 360973 | tungsten formylmethanofuran dehydrogenase, subunit C {*Methanobacterium thermoautotrophicum*} | 52.7 | 67.7 | 768 |
| MJ0658 | 887575 | 886886 | tungsten formylmethanofuran dehydrogenase, subunit C related protein {*Methanobacterium thermoautotrophicum*} | 35.4 | 53.4 | 690 |

TABLE 1A-continued

| | | | | | | |
|---|---|---|---|---|---|---|
| MJ1168 | 364202 | 363852 | tungsten formylmethanofuran dehydrogenase, subunit D {*Methanobacterium thermoautotrophicum*} | 55.2 | 74.8 | 351 |
| MJ1165 | 366038 | 365637 | tungsten formylmethanofuran dehydrogenase, subunit E {*Methanobacterium thermoautotrophicum*} | 38.3 | 61.1 | 402 |
| MJ1166 | 365484 | 364567 | tungsten formylmethanofuran dehydrogenase, subunit F {*Methanobacterium thermoautotrophicum*} | 47.6 | 67.4 | 918 |
| MJ1167 | 364516 | 364271 | tungsten formylmethanofuran dehydrogenase, subunit G {*Methanobacterium thermoautotrophicum*} | 43.1 | 58.5 | 246 |
| Fatty acid and phospholipid metabolism | | | | | | |
| MJ0705 | 840072 | 838927 | 3-hydroxy-3-methylglutaryl coenzyme A reductase {*Haloferax volcanii*} | 49.8 | 67.3 | 1146 |
| MJ1546 | 1612371 | 1611697 | acyl carrier protein synthase {*Pyrococcus furiosus*} | 63.1 | 78.0 | 675 |
| MJ0860 | 688696 | 689499 | bifunctional short chain isoprenyl diphosphate synthase {*Methanobacterium thermoautotrophicum*} | 49.5 | 71.7 | 804 |
| MJ1229 | 299478 | 300644 | biotin carboxylase {Anabaena sp} | 58.9 | 76.2 | 1167 |
| MJ1212 | 316229 | 316786 | CDP-diacylglycerol-serine O-phosphatidyltransferase {*Bacillus subtilis*} | 45.5 | 63.7 | 558 |
| MJ1504 | 1661217 | 1662188 | lipopolysaccharide biosynthesis protein (bp1D) {*Bordetella pertussis*} | 44.3 | 63.1 | 972 |
| MJ1087 | 446091 | 445231 | melvalonate kinase {*Schizosaccharomyces pombe*} | 31.5 | 53.7 | 861 |
| MJ1549 | 1610772 | 1609735 | nonspecific lipid-transfer protein {*Pyrococcus furiosus*} | 46.9 | 66.0 | 1038 |
| Purines, pyrimidines, nucleosides, and nucleotides | | | | | | |
| 2'-Deoxyribonucleotide metabolism | | | | | | |
| MJ0832 | 719820 | 714604 | anaerobic ribonucleoside-triphosphate reductase {*Escherichia coli*} | 28.1 | 49.9 | 5217 |
| MJ0430 | 1085497 | 1086009 | deoxycytidine triphosphate deaminase {*Desulfurolobus ambivalens*} | 40.4 | 61.5 | 513 |
| MJ1102 | 429115 | 428648 | deoxycytidine triphosphate deaminase, putative {*Desulfurolobus ambivalens*} | 32.1 | 53.2 | 468 |
| MJ0511 | 1019410 | 1020075 | deoxyuridylate hydroxymethylase {*Methanobacterium thermoautotrophicum*} | 39.4 | 59.6 | 666 |
| MJ0937 | 606252 | 604921 | glycinamide ribonucleotide synthetase {*Homo sapiens*} | 37.1 | 55.0 | 1332 |
| Purine ribonucleotide biosynthesis | | | | | | |
| MJ0929 | 613484 | 612135 | adenylosuccinate lyase {*Bacillus subtilis*} | 42.6 | 67.4 | 1350 |
| MJ0561 | 976592 | 975741 | adenylosuccinate synthetase {*Haemophilus influenzae*} | 41.0 | 59.1 | 852 |
| MJ1575 | 1586386 | 1585823 | GMP synthetase {*Borrelia burgdorferi*} | 41.4 | 66.7 | 564 |
| MJ1131 | 399509 | 400264 | GMP synthetase {*Haemophilus influenzae*} | 52.0 | 72.3 | 756 |
| MJ1616 | 1545605 | 1544271 | inosine-5-monophosphate dehydrogenase {*Pyrococcus furiosus*} | 61.8 | 80.4 | 1335 |
| MJ1265 | 262116 | 262436 | nucleoside diphosphate kinase {*Haemophilus influenzae*} | 51.5 | 68.3 | 321 |
| MJ0616 | 925486 | 925941 | phosphoribosylaminoimidazole carboxylase {*Methanobrevibacter smithii*} | 56.3 | 76.2 | 456 |
| MJ1592 | 1572482 | 1572009 | phosphoribosylaminoimidazolesuccinocarboxamide synthase {*Bacillus subtilis*} | 51.0 | 69.1 | 474 |
| MJ0203 | 1277597 | 1276734 | phosphoribosylformylglycinamidine cyclo-ligase {*Bacillus subtilis*} | 42.7 | 64.4 | 864 |
| MJ1648 | 1507541 | 1507071 | phosphoribosylformylglycinamidine synthase I {*Bacillus subtilis*} | 52.9 | 71.5 | 471 |
| MJ1264 | 262585 | 264714 | phosphoribosylformylglycinamidine synthase II {*Bacillus subtilis*} | 43.3 | 65.1 | 2130 |
| MJ1486 | 13611 | 14633 | phosphoribosylglycinamide formyltransferase 2 {*Bacillus subtilis*} | 61.8 | 75.9 | 1023 |
| MJ1366 | 155580 | 156431 | ribose-phosphate pyrophosphokinase {*Haemophilus influenzae*} | 34.1 | 55.5 | 852 |
| Pyrimidine ribonucleotide biosynthesis | | | | | | |
| MJ1581 | 1581578 | 1580661 | aspartate carbamoyltransferase catalytic chain {*Escherichia coli*} | 50.0 | 70.7 | 918 |
| MJ1406 | 104548 | 104183 | aspartate carbamoyltransferase regulatory chain {*Escherichia coli*} | 39.1 | 65.1 | 366 |
| MJ1378 | 145461 | 144037 | carbamoyl-phosphate synthase, large chain {*Bacillus subtilis*} | 59.7 | 80.0 | 1425 |
| MJ1381 | 143097 | 141328 | carbamoyl-phosphate synthase, pyrimidine-specific, large subunit {*Bacillus caldolyticus*} | 54.7 | 75.7 | 1770 |
| MJ1019 | 523003 | 522041 | carbamoyl-phosphate synthase, small chain {*Bacillus subtilis*} | 49.6 | 69.1 | 963 |
| MJ1174 | 358774 | 360279 | CTP synthase {*Haemophilus influenzae*} | 56.7 | 74.0 | 1506 |
| MJ0656 | 888785 | 888306 | cytidylate kinase {*Bacillus subtilis*} | 31.9 | 59.5 | 480 |
| MJ1490 | 8032 | 6764 | dihydroorotase {*Bacillus caldolyticus*} | 34.5 | 56.3 | 1269 |
| MJ0654 | 889442 | 890284 | dihydroorotase dehydrogenase {*Bacillus subtilis*} | 43.1 | 66.6 | 843 |
| MJ0293 | 1196756 | 1196196 | thymidylate kinase {*Schizosaccharomyces pombe*} | 31.2 | 58.7 | 561 |
| MJ1109 | 421875 | 421348 | uridine 5'-monophosphate synthase {*Dictyostelium discoideum*} | 38.4 | 64.6 | 528 |
| MJ1259 | 271220 | 270543 | uridylate kinase {*Haemophilus influenzae*} | 27.5 | 48.7 | 678 |
| Salvage of nucleosides and nucleotides | | | | | | |
| MJ1459 | 43987 | 42413 | adenine deaminase {*Bacillus subtilis*} | 35.9 | 61.7 | 1575 |
| MJ1655 | 1499440 | 1499075 | adenine phosphoribosyltransferase {*Haemophilus influenzae*} | 35.8 | 62.5 | 366 |
| MJ0060 | 1412894 | 1412139 | methylthioadenosine phosphorylase {*Homo sapiens*} | 41.3 | 63.2 | 756 |
| MJ0667 | 879550 | 878150 | thymidine phosphorylase {*Mycoplasma genitalium*} | 30.5 | 52.2 | 1401 |
| Sugar-nucleotide biosynthesis and conversions | | | | | | |
| MJ1101 | 430386 | 429235 | glucose-1-phosphate thymidylyltransferase {*Streptomyces griseus*} | 32.0 | 56.0 | 1152 |
| MJ1334 | 188314 | 189084 | UDP-glucose pyrophosphorylase {*Mycoplasma genitalium*} | 42.7 | 63.6 | 771 |
| Regulatory functions | | | | | | |
| MJ0800 | 748410 | 747352 | activator of (R)-2-hydroxyglutaryl-CoA dehydratase {*Acidaminococcus fermentans*} | 31.8 | 51.2 | 1059 |
| MJ0004 | 1466944 | 1466255 | activator of (R)-2-hydroxyglutaryl-CoA dehydratase {*Acidaminococcus fermentans*} | 39.0 | 61.1 | 690 |
| MJ1344 | 180975 | 181229 | nitrogen regulatory protein P-II {*Haemophilus influenzae*} | 56.5 | 73.0 | 255 |

TABLE 1A-continued

| | | | | | | |
|---|---|---|---|---|---|---|
| MJ0059 | 1413301 | 1413047 | nitrogen regulatory protein P-II {*Haemophilus influenzae*} | 56.5 | 75.3 | 255 |
| MJ0300 | 1188832 | 1188194 | putative transcriptional regulator {*Bacillus subtilis*} | 27.8 | 50.3 | 639 |
| MJ0151 | 1325766 | 1325323 | putative transcriptional regulator {*Pyrococcus furiosus*} | 51.0 | 65.0 | 444 |
| MJ0723 | 815573 | 815190 | putative transcriptional regulator {*Pyrococcus furiosus*} | 51.2 | 82.3 | 384 |

Replication

Degradation of DNA

| | | | | | | |
|---|---|---|---|---|---|---|
| MJ1434 | 68536 | 68048 | endonuclease III {*Bacillus subtilis*} | 28.7 | 58.1 | 489 |
| MJ0613 | 927393 | 928424 | endonuclease III {*Bacillus subtilis*} | 41.3 | 66.3 | 1032 |
| MJ1439 | 65786 | 65208 | thermonuclease precursor {*Staphylococcus hyicus*} | 36.8 | 64.1 | 579 |

DNA replication, restriction, modification, recombination, and repair

| | | | | | | |
|---|---|---|---|---|---|---|
| MJ1029 | 510633 | 509875 | dimethyladenosine transferase {*Bacillus subtilis*} | 38.4 | 58.8 | 759 |
| MJ0104 | 1373055 | 1371130 | DNA helicase, putative {*Homo sapiens*} | 35.2 | 56.7 | 1926 |
| MJ0171 | 1297428 | 1299053 | DNA ligase {*Desulfurolobus ambivalens*} | 35.8 | 62.4 | 1626 |
| MJ0869 | 680404 | 679445 | DNA repair protein {*Saccharomyces cerevisiae*} | 44.6 | 62.2 | 960 |
| MJ1444 | 58945 | 58052 | DNA repair protein RAD2 {*Homo sapiens*} | 37.3 | 63.5 | 894 |
| MJ0254 | 1232179 | 1231757 | DNA repair protein RAD51 {*Homo sapiens*} | 32.5 | 58.4 | 423 |
| MJ0961 | 579580 | 577424 | DNA replication initiator protein {*Xenopus laevis*} | 28.1 | 40.0 | 2157 |
| MJ1652 | 1503610 | 1501559 | DNA topoisomerase I {*Mycoplasma genitalium*} | 34.0 | 55.0 | 2052 |
| MJ0885 | 656470 | 660960 | DNA-dependent DNA polymerase family B {Pyrococcus sp.} | 47.3 | 68.0 | 4491 |
| MJ1529 | 1630880 | 1630413 | methylated DNA protein cysteine methyltransferase {*Haemophilus influenzae*} | 35.9 | 66.4 | 468 |
| MJ1498 | 1548 | 715 | modification methylase {*Haemophilus parainfluenzae*} | 31.6 | 52.2 | 834 |
| MJ0598 | 942522 | 941860 | modification methylase {*Haemophilus influenzae*} | 32.4 | 53.8 | 663 |
| MJ1328 | 193775 | 192987 | modification methylase {*Haemophilus influenzae*} | 31.1 | 56.1 | 789 |
| MJ0563 | 974521 | 975309 | modification methylase {*Methanobacterium thermoformicicum*} | 34.7 | 56.2 | 789 |
| MJ1200 | 326214 | 327248 | modification methylase {*Desulfovibrio desulfuricans*} | 39.7 | 56.7 | 1035 |
| MJ0985 | 555045 | 555896 | modification methylase {*Methanobacterium thermoformicicum*} | 54.5 | 73.0 | 852 |
| MJ1149 | 383742 | 384248 | mutator mutT protein {*Escherichia coli*} | 40.3 | 63.9 | 507 |
| MJ0942 | 600802 | 598916 | probable ATP dependent helicase {*Haemophilus influenzae*} | 31.9 | 54.7 | 1887 |
| MJ0247 | 1237945 | 1237322 | proliferating-cell nuclear antigen {*Saccharomyces cerevisiae*} | 31.5 | 54.3 | 624 |
| MJ0026 | 1444598 | 1445224 | proliferating-cell nucleolar antigen, 120 kDa {*Homo sapiens*} | 48.1 | 66.1 | 627 |
| MJ1422 | 79304 | 84727 | replication factor C {*Homo sapiens*} | 45.2 | 64.6 | 5424 |
| MJ0884 | 662042 | 660969 | replication factor C, large subunit {*Homo sapiens*} | 32.5 | 49.2 | 1074 |
| MJ1220 | 308420 | 310102 | restriction modification enzyme, subunit M1 {*Mycoplasma pulmonis*} | 32.9 | 54.4 | 1683 |
| MJ0132 | 1345009 | 1345548 | restriction modification enzyme, subunit M1 {*Mycoplasma pulmonis*} | 37.3 | 61.1 | 540 |
| MJ0130 | 1346511 | 1347179 | restriction modification system S subunit {*Spiroplasma citri*} | 29.3 | 59.2 | 669 |
| MJ1512 | 1653580 | 1648742 | reverse gyrase {*Sulfolobus acidocaldarius*} | 41.8 | 62.4 | 4839 |
| MJ0135 | 1341301 | 1341939 | ribonuclease HII (rnhB) {*Escherichia coli*} | 45.2 | 64.6 | 639 |
| MJECL42 | 55944 | 54271 | type I restriction enyzme ECOR124/3 I M protein {*Haemophilus influenzae*} | 39.7 | 61.4 | 1673 |
| MJ0124 | 1349371 | 1352847 | type I restriction enzyme {*Haemophilus influenzae*} | 31.1 | 52.2 | 3477 |
| MJ1214 | 313714 | 315828 | type I restriction enzyme {*Haemophilus influenzae*} | 29.5 | 52.2 | 2115 |
| MJECL40 | 52581 | 49456 | type I restriction enzyme {*Haemophilus influenzae*} | 36.2 | 59.9 | 3125 |
| MJ1531 | 1629137 | 1628493 | type I restriction enzyme CfrI, specificity subunit {*Citrobacter freundii*} | 38.4 | 57.9 | 645 |
| MJ1218 | 310547 | 311776 | type I restriction-modification enzyme, S subunit {*Escherichia coli*} | 29.7 | 49.7 | 1230 |
| MJ0984 | 556397 | 555909 | type II restriction enzyme {*Methanobacterium thermoformicicum*} | 45.9 | 67.2 | 489 |
| MJ0600 | 940932 | 940315 | type II restriction enzyme DPNII {*Streptococcus pneumoniae*} | 46.0 | 67.4 | 618 |

Transcription

DNA-dependent RNA polymerases

| | | | | | | |
|---|---|---|---|---|---|---|
| MJ1042 | 497715 | 493732 | DNA-dependent RNA polymerase, subunit A' {*Methanococcus vannielii*} | 74.5 | 88.1 | 3984 |
| MJ1043 | 493546 | 491078 | DNA-dependent RNA polymerase, subunit A" {*Methanococcus vannielii*} | 66.7 | 83.5 | 2469 |
| MJ1041 | 499305 | 497866 | DNA-dependent RNA polymerase, subunit B' {*Methanococcus vannielii*} | 76.3 | 91.3 | 1440 |
| MJ1040 | 501124 | 499862 | DNA-dependent RNA polymerase, subunit B" {*Methanococcus vannielii*} | 72.7 | 87.4 | 1263 |
| MJ0192 | 1283621 | 1283148 | DNA-dependent RNA polymerase, subunit D {*Arabidopsis thaliana*} | 39.5 | 58.6 | 474 |
| MJ0397 | 1113901 | 1114371 | DNA-dependent RNA polymerase, subunit E' {*Sulfolobus acidocaldarius*} | 47.9 | 70.8 | 471 |
| MJ0396 | 1114384 | 1114560 | DNA-dependent RNA polymerase, subunit E" {*Sulfolobus acidocaldarius*} | 35.9 | 62.3 | 177 |
| MJ1039 | 501599 | 501366 | DNA-dependent RNA polymerase, subunit H {*Methanococcus vannielii*} | 49.4 | 78.7 | 234 |
| MJ1390 | 134111 | 134350 | DNA-dependent RNA polymerase, subunit I {*Sulfolobus acidocaldarius*} | -0.9 | -0.9 | 240 |
| MJ0197 | 1281417 | 1281247 | DNA-dependent RNA polymerase, subunit K {*Haloarcula marismortui*} | 43.5 | 65.3 | 171 |
| MJ0387 | 1119216 | 1119512 | DNA-dependent PNA polymerase, subunit L {*Sulfolobus acidocaldarius*} | 35.6 | 63.4 | 297 |
| MJ0196 | 1281779 | 1281561 | DNA-dependent RNA polymerase, subunit N {*Haloarcula marismortui*} | 53.8 | 83.4 | 219 |

Transcription factors

| | | | | | | |
|---|---|---|---|---|---|---|
| MJ0941 | 601867 | 600923 | putative transcription initiation factor IIIC {*Saccharomyces cerevisiae*} | 20.1 | 44.1 | 945 |
| MJ1045 | 490363 | 489848 | putative transcription termination-antitermination factor nusA {*Methanococcus vannielii*} | 47.9 | 73.7 | 516 |
| MJ0372 | 1134509 | 1134123 | putative transcription termination-antitermination factor nusG {*Homo sapiens*} | 38.6 | 63.8 | 387 |
| MJ0507 | 1024170 | 1024631 | TATA-binding transcription initiation factor {*Thermococcus celer*} | 51.4 | 74.0 | 462 |
| MJ0782 | 766586 | 768592 | transcription initiation factor IIB {*Pyrococcus woesei*} | 63.8 | 77.6 | 2007 |
| MJ1148 | 384277 | 384567 | transcription-associated protein, ('TFIIS') {*Thermococcus celer*} | 56.4 | 69.0 | 291 |

RNA processing

| | | | | | | |
|---|---|---|---|---|---|---|
| MJ0697 | 849814 | 849125 | fibrillarin-like pre-rRNA processing protein {*Methanococcus vannielii*} | 75.3 | 88.3 | 690 |

TABLE 1A-continued

Translation

| | | | | | | |
|---|---|---|---|---|---|---|
| MJ0160 | 1308036 | 1309265 | PET112 protein {*Saccharomyces cerevisiae*} | 32.3 | 53.7 | 1230 |

Amino acyl tRNA synthetases

| | | | | | | |
|---|---|---|---|---|---|---|
| MJ0564 | 971657 | 974149 | alanyl-tRNA synthetase (alaRS) {*Haemophilus influenzae*} | 28.0 | 53.1 | 2493 |
| MJ0237 | 1244137 | 1242641 | arginyl-tRNA synthetase {*Mycobacterium leprae*} | 31.3 | 52.7 | 1497 |
| MJ1555 | 1605935 | 1604679 | aspartyl-tRNA synthetase {*Pyrococcus sp.*} | 57.8 | 75.6 | 1257 |
| MJ1377 | 145796 | 147325 | glutamyl-tRNA synthetase {*Methanobacterium thermoautotrophicum*} | 51.7 | 73.6 | 1530 |
| MJ0228 | 1253254 | 1251524 | glycyl tRNA synthetase {*Schizosaccharomyces pombe*} | 45.8 | 65.2 | 1731 |
| MJ1000 | 543634 | 542396 | histidyl-tRNA synthetase {*Streptococcus equisimilis*} | 35.5 | 56.3 | 1239 |
| MJ0947 | 591914 | 594817 | isoleucyl-tRNA synthetase {*Methanobacterium thermoautotrophicum*} | 52.1 | 70.0 | 2904 |
| MJ0633 | 912642 | 910015 | leucyl-tRNA synthetase {*Saccharomyces cerevisiae*} | 34.4 | 54.9 | 2628 |
| MJ1263 | 266697 | 264745 | methionyl-tRNA synthetase {*Haemophilus influenzae*} | 35.6 | 56.0 | 1953 |
| MJ0487 | 1041343 | 1039994 | phenylalanyl-tRNA synthetase, subunit alpha {*Saccharomyces cerevisiae*} | 41.0 | 64.0 | 1350 |
| MJ1108 | 423555 | 425198 | phenylalanyl-tRNA synthetase, subunit beta {*Saccharomyces cerevisiae*} | 31.6 | 55.4 | 1644 |
| MJ1238 | 287985 | 289172 | prolyl-tRNA synthetase {*Homo sapiens*} | 39.3 | 59.5 | 1188 |
| MJ1197 | 332116 | 330257 | threonyl-tRNA synthetase {*Synechocystis sp.*} | 29.1 | 52.1 | 1860 |
| MJ1415 | 96418 | 95369 | tryptophanyl-tRNA synthetase {*Schizosaccharomyces pombe*} | 30.5 | 55.3 | 1050 |
| MJ0389 | 1118380 | 1117616 | tyrosyl-tRNA synthetase {*Homo sapiens*} | 39.9 | 63.7 | 765 |
| MJ1007 | 536642 | 534186 | valyl-tRNA synthetase {*Bacillus stearothermophilus*} | 36.1 | 56.6 | 2457 |

Degradation of proteins, peptides, and glycopeptides

| | | | | | | |
|---|---|---|---|---|---|---|
| MJ1176 | 356300 | 357370 | ATP-dependent 26S protease regulatory subunit 4 {*Homo sapiens*} | 51.0 | 74.1 | 1071 |
| MJ1494 | 4302 | 5123 | ATP-dependent 26S protease regulatory subunit 8 {*Methanobacterium thermoautotrophicum*} | 58.6 | 78.2 | 822 |
| MJ1417 | 93716 | 91932 | ATP-dependent protease La {*Bacillus brevis*} | 32.8 | 54.3 | 1785 |
| MJ0090 | 1387867 | 1386755 | collagenase {*Porphyromonas gingivalis*} | 32.6 | 35.2 | 1113 |
| MJ1130 | 400455 | 401969 | O-sialoglycoprotein endopeptidase {*Saccharomyces cerevisiae*} | 50.6 | 67.9 | 1515 |
| MJ0651 | 891988 | 892842 | protease IV {*Haemophilus influenzae*} | 35.0 | 56.2 | 855 |
| MJ0591 | 947601 | 946861 | proteasome, subunit alpha {*Methanosarcina thermophila*} | 57.5 | 78.8 | 741 |
| MJ1237 | 289440 | 289967 | proteasome, subunit beta {*Methanosarcina thermophila*} | 47.5 | 68.2 | 528 |
| MJ0806 | 742381 | 743364 | xaa-pro dipeptidase {*Lactobacillus delbrueckii*} | 36.1 | 65.2 | 984 |
| MJ0996 | 547987 | 546635 | Zn protease {*Haemophilus influenzae*} | 33.9 | 55.0 | 1353 |

Protein modification

| | | | | | | |
|---|---|---|---|---|---|---|
| MJ0814 | 733804 | 734793 | deoxyhypusine synthase {*Homo sapiens*} | 50.0 | 70.7 | 990 |
| MJ1274 | 253925 | 254653 | diphthine synthase {*Saccharomyces cerevisiae*} | 40.7 | 61.5 | 729 |
| MJ0172 | 1296723 | 1297175 | L-isoaspartyl protein carboxyl methyltransferase {*Escherichia coli*} | 47.6 | 59.4 | 453 |
| MJ1329 | 192979 | 192098 | methionine aminopeptidase {*Saccharomyces cerevisiae*} | 36.2 | 55.1 | 882 |
| MJ1530 | 1630123 | 1629764 | N-terminal acetyltransferase complex, subunit ARD1 {*Homo sapiens*} | 39.7 | 55.7 | 360 |
| MJ1591 | 1573833 | 1573072 | selenium donor protein {*Homo sapiens*} | 34.3 | 57.1 | 762 |

Ribosomal proteins: synthesis and modification

| | | | | | | |
|---|---|---|---|---|---|---|
| MJ0509 | 1022576 | 1023502 | acidic ribosomal protein P0 (L10E) {*Methanococcus vannielii*} | 63.2 | 82.1 | 927 |
| MJ0242 | 1240163 | 1240228 | ribosomal protein HG12 {*Catus (cat)*} | 63.7 | 81.9 | 66 |
| MJ1203 | 325110 | 325460 | ribosomal protein HS6-type {*Haloarcula marismortui*} | 47.0 | 71.4 | 351 |
| MJ0510 | 1021912 | 1022460 | ribosomal protein L1 {*Methanococcus vannielii*} | 64.5 | 80.3 | 549 |
| MJ0373 | 1133926 | 1133540 | ribosomal protein L11 {*Sulfolobus solfataricus*} | 47.2 | 72.4 | 387 |
| MJ0508 | 1023632 | 1023937 | ribosomal protein L12 {*Methanococcus vannielii*} | 72.8 | 80.9 | 306 |
| MJ0194 | 1282568 | 1282260 | ribosomal protein L13 {*Haloarcula marismortui*} | 44.9 | 66.4 | 309 |
| MJ0466 | 1058694 | 1058452 | ribosomal protein L14 {*Methanococcus vannielii*} | 78.8 | 92.5 | 243 |
| MJ0657 | 888216 | 887977 | ribosomal protein L14B {*Saccharomyces cerevisiae*} | 36.4 | 59.8 | 240 |
| MJ0477 | 1052625 | 1052302 | ribosomal protein L15 {*Methanococcus vannielii*} | 62.7 | 79.5 | 324 |
| MJ0983 | 556982 | 557290 | ribosomal protein L15B {*Thermoplasma acidophilum*} | 62.3 | 78.6 | 309 |
| MJ0474 | 1054523 | 1053939 | ribosomal protein L18 {*Methanococcus vannielii*} | 73.3 | 84.3 | 585 |
| MJ0473 | 1054978 | 1054559 | ribosomal protein L19 {*Methanococcus vannielii*} | 67.0 | 86.4 | 420 |
| MJ0179 | 1291786 | 1291052 | ribosomal protein L2 {*Methanococcus vannielii*} | 74.0 | 87.0 | 735 |
| MJ0040 | 1431958 | 1432260 | ribosomal protein L21 {*Haloarcula marismortui*} | 54.5 | 62.3 | 303 |
| MJ0460 | 1061493 | 1061089 | ribosomal protein L22 {*Haloarcula marismortui*} | 40.7 | 61.7 | 405 |
| MJ0178 | 1292097 | 1291840 | ribosomal protein L23 {*Methanococcus vannielii*} | 69.8 | 91.9 | 258 |
| MJ0467 | 1058340 | 1058062 | ribosomal protein L24 {*Methanococcus vannielii*} | 70.5 | 83.0 | 279 |
| MJ1201 | 325929 | 326078 | ribosomal protein L24E {*Haloarcula marismortui*} | 54.6 | 66.7 | 150 |
| MJ0462 | 1060388 | 1060212 | ribosomal protein L29 {*Halobacterium halobium*} | 51.0 | 69.9 | 177 |
| MJ0193 | 1283076 | 1282705 | ribosomal protein L29E {*Haloarcula marismortui*} | 48.7 | 68.7 | 372 |
| MJ0176 | 1293794 | 1292934 | ribosomal protein L3 {*Haloarcula marismortui*} | 45.2 | 63.9 | 861 |
| MJ1044 | 490704 | 490399 | ribosomal protein L30 {*Methanococcus vannielii*} | 63.9 | 84.1 | 306 |
| MJ0049 | 1421907 | 1422152 | ribosomal protein L31{*Nicotiana glutinosa*} | 40.9 | 66.2 | 246 |
| MJ0472 | 1055464 | 1055063 | ribosomal protein L32 {*Methanococcus vannielii*} | 58.0 | 77.4 | 402 |
| MJ0655 | 889197 | 888931 | ribosomal protein L34 {*Aedes albopictus*} | 36.8 | 58.3 | 267 |
| MJ0098 | 1380525 | 1380686 | ribosomal protein L37 {*Leishmania infantum,*} | 50.0 | 67.4 | 162 |
| MJ0593 | 945958 | 945683 | ribosomal protein L37a {*Homo sapiens*} | 44.6 | 58.7 | 276 |
| MJ0177 | 1292889 | 1292134 | ribosomal protein L4 (human) {*Haloarcula marismortui*} | 49.4 | 66.3 | 756 |
| MJ0707 | 838122 | 838229 | ribosomal protein L40 {*Saccharomyces cerevisiae*} | 57.6 | 66.7 | 108 |
| MJ0249 | 1236729 | 1236448 | ribosomal protein L44 {*Haloarcula marismortui*} | 38.8 | 58.1 | 282 |
| MJ0689 | 854995 | 855150 | ribosomal protein L46 {*Sulfolobus solfataricus,*} | 52.0 | 70.0 | 156 |
| MJ0469 | 1057259 | 1056723 | ribosomal protein L5 {*Methanococcus vannielii*} | 72.5 | 84.5 | 537 |
| MJ0471 | 1056071 | 1055526 | ribosomal protein L6 {*Methanococcus vannielii*} | 66.5 | 82.5 | 546 |
| MJ0476 | 1053137 | 1052745 | ribosomal protein L7 {*Methanococcus vannielii*} | 70.3 | 88.6 | 393 |

TABLE 1A-continued

| | | | | | | | |
|---|---|---|---|---|---|---|---|
| MJ0595 | 944670 | 944473 | ribosomal protein LX {*Sulfolobus acidocaldarius*} | | 38.9 | 66.7 | 198 |
| MJ0322 | 1172916 | 1173218 | ribosomal protein S10 {*Pyrococcus woesei*} | | 67.0 | 91.0 | 303 |
| MJ0191 | 1283956 | 1283735 | ribosomal protein S11 {*Haloarcula marismortui*} | | 67.2 | 80.0 | 222 |
| MJ1046 | 489559 | 489260 | ribosomal protein S12 {*Methanococcus vannielii*} | | 87.0 | 96.0 | 300 |
| MJ0036 | 1434801 | 1434352 | ribosomal protein S13 {*Brugia pahangi*,} | | 49.4 | 71.0 | 450 |
| MJ1474 | 26554 | 26054 | ribosomal protein S15A {*Brassica napus*} | | 21.7 | 48.2 | 501 |
| MJ0465 | 1059233 | 1058883 | ribosomal protein S17 {*Methanococcus vannielii*} | | 71.6 | 82.4 | 351 |
| MJ0245 | 1238750 | 1238896 | ribosomal protein S17B {*Saccharomyces cerevisiae*} | | 55.4 | 80.9 | 147 |
| MJ0189 | 1285220 | 1284771 | ribosomal protein S18 {*Arabidopsis thaliana*} | | 42.3 | 68.5 | 450 |
| MJ0180 | 1290861 | 1290508 | ribosomal protein S19 {*Haloarcula marismortui*} | | 56.9 | 73.3 | 354 |
| MJ0692 | 853669 | 854046 | ribosomal protein S19S {*Ascaris suum*} | | 49.6 | 67.0 | 378 |
| MJ0394 | 1115064 | 1115366 | ribosomal protein S24 {*Haloarcula marismortui*} | | 42.6 | 64.4 | 303 |
| MJ0250 | 1236377 | 1236192 | ribosomal protein S27 {*Saccharomyces cerevisiae*} | | 42.6 | 53.8 | 186 |
| MJ0393 | 1115369 | 1115548 | ribosomal protein S27A {*Caenorhabditis elegans*} | | 58.4 | 68.8 | 180 |
| MJ0461 | 1061060 | 1060437 | ribosomal protein S3 {*Haloarcula marismortui*} | | 49.1 | 72.1 | 624 |
| MJ1202 | 325575 | 325808 | ribosomal protein S33 {*Kluyveromyces lactis*} | | 62.1 | 81.1 | 234 |
| MJ0980 | 558761 | 559252 | ribosomal protein S3a {*Catharanthus roseus*} | | 29.8 | 52.1 | 492 |
| MJ0190 | 1284710 | 1284150 | ribosomal protein S4 {*Sulfolobus acidocaldarius*} | | 51.3 | 68.4 | 561 |
| MJ0468 | 1057935 | 1057318 | ribosomal protein S4E {*Methanococcus vannielii*} | | 70.9 | 84.5 | 618 |
| MJ0475 | 1053877 | 1053275 | ribosomal protein S5 {*Methanococcus vannielii*} | | 75.7 | 88.6 | 603 |
| MJ1260 | 270075 | 269683 | ribosomal protein S6 {*Homo sapiens*} | | 36.2 | 58.0 | 393 |
| MJ0620 | 922671 | 921799 | ribosomal protein S6 modification protein {*Haemophilus influenzae*} | | 34.4 | 57.3 | 873 |
| MJ1001 | 542227 | 541487 | ribosomal protein S6 modification protein II {*Haemophilus influenzae*} | | 24.8 | 47.4 | 741 |
| MJ1047 | 489046 | 488627 | ribosomal protein S7 {*Methanococcus vannielii*} | | 65.8 | 83.6 | 420 |
| MJ0470 | 1056445 | 1056113 | ribosomal protein S8 {*Methanococcus vannielii*} | | 71.2 | 89.2 | 333 |
| MJ0673 | 873106 | 872720 | ribosomal protein S8E {*Haloarcula marismortui*} | | 50.0 | 69.7 | 387 |
| MJ0195 | 1282118 | 1281840 | ribosomal protein S9 {*Haloarcula marismortui*} | | 50.0 | 75.0 | 279 |
| tRNA modification | | | | | | | |
| MJ0946 | 595006 | 596040 | N2,N2-dimethylguanosine tRNA methyltransferase {*Saccharomyces cerevisiae*} | | 31.6 | 56.0 | 1035 |
| MJ1675 | 1478684 | 1477755 | pseudouridylate synthase I {*Haemophilus influenzae*} | | 33.5 | 57.2 | 930 |
| MJ0436 | 1081116 | 1082732 | queuine tRNA ribosyltransferase {*Escherichia coli*} | | 30.4 | 47.6 | 1617 |
| Translation factors | | | | | | | |
| MJ0829 | 723534 | 722260 | peptide chain release factor, eRF, subunit 1 {*Xenopus laevis*} | | 33.0 | 57.3 | 1275 |
| MJ1505 | 1659133 | 1661085 | putative ATP-dependent RNA helicase, eIF-4A family {*Saccharomyces cerevisiae*} | | 30.8 | 51.9 | 1953 |
| MJ1574 | 1587062 | 1588927 | putative ATP-dependent RNA helicase, eIF-4A family {*Bacillus subtilis*} | | 33.1 | 56.0 | 1866 |
| MJ0669 | 876636 | 877637 | putative ATP-dependent RNA helicase, eIF-4A family {*Bacillus subtilis*} | | 44.5 | 65.8 | 1002 |
| MJ0495 | 1035432 | 1034644 | putative translation factor, EF-TU/1 alpha family {*Thermus aquaticus*} | | 36.9 | 55.9 | 1389 |
| MJ0262 | 1225060 | 1221653 | putative translation initiation factor, FUN12/bIF-2 family {*Saccharomyces cerevisiae*} | | 39.3 | 61.5 | 3408 |
| MJ0324 | 1171724 | 1172830 | translation elongation factor, EF-1 alpha {*Methanococcus vannielii*} | | 78.9 | 90.8 | 1107 |
| MJ1048 | 488471 | 486336 | translation elongation factor, EF-2 {*Methanococcus vannielii*} | | 74.8 | 88.5 | 2136 |
| MJ0445 | 1073262 | 1073483 | translation initiation factor, eIF-1A {*Thermoplasma acidophilum*} | | 52.8 | 70.3 | 222 |
| MJ0117 | 1357516 | 1358196 | translation initiation factor, eIF-2, subunit alpha {*Saccharomyces cerevisiae*} | | 32.2 | 56.5 | 681 |
| MJ0097 | 1380885 | 1381313 | translation initiation factor, eIF-2, subunit beta {*Drosophila melanogaster*} | | 32.1 | 60.4 | 429 |
| MJ1261 | 269396 | 268164 | translation initiation factor, eIF-2, subunit gamma {*Homo sapiens*} | | 52.6 | 71.9 | 1233 |
| MJ0454 | 1066217 | 1067065 | translation initiation factor, eIF-2B, subunit alpha {*Saccharomyces cerevisiae*} | | 37.9 | 56.4 | 849 |
| MJ0122 | 1353264 | 1354127 | translation initiation factor, eIP-2B, subunit delta {*Mus musculus*} | | 29.4 | 54.6 | 864 |
| MJ1228 | 300895 | 301236 | translation initiation factor, eIF-5a {*Sulfolobus acidocaldarius*} | | 50.0 | 69.7 | 342 |
| Transport and binding proteins | | | | | | | |
| MJ0719 | 818577 | 820289 | ABC transporter ATP-binding protein {*Saccharomyces cerevisiae*} | | 49.6 | 66.9 | 1713 |
| MJ1023 | 518606 | 517821 | ABC transporter ATP-binding protein {*Bacillus firmus*} | | 49.2 | 72.4 | 786 |
| MJ1572 | 1590114 | 1589518 | ABC transporter ATP-binding protein {*Mycoplasma genitalium*} | | 50.0 | 87.5 | 597 |
| MJ0035 | 1435236 | 1435829 | ABC transporter subunit {*Cyanelle Cyanophora*} | | 33.9 | 58.1 | 594 |
| MJ1508 | 1656015 | 1655446 | ABC transporter, probable ATP-binding subunit {*Haemophilus influenzae*} | | 45.7 | 68.3 | 570 |
| MJ1332 | 189987 | 191117 | GTP-binding protein {*Saccharomyces cerevisiae*} | | 38.7 | 59.8 | 1131 |
| MJ1326 | 196392 | 195292 | GTP-binding protein {*Schizosaccharomyces pombe*} | | 51.4 | 71.5 | 1101 |
| MJ1408 | 103449 | 102430 | GTP-binding protein, GTP1/OBG-family {*Saccharomyces cerevisiae*} | | 30.5 | 58.4 | 1020 |
| MJ1464 | 39865 | 38858 | hypothetical GTP-binding protein (SP:P40010) {*Saccharomyces cerevisiae*} | | 32.0 | 55.5 | 1008 |
| MJ1033 | 507274 | 506324 | magnesium and cobalt transport protein {*Haemophilus influenzae*} | | 42.2 | 57.9 | 951 |
| MJ0091 | 1386551 | 1385751 | Na+/Ca+ exchanger protein {*Escherichia coli*} | | 32.3 | 58.6 | 801 |
| MJ0283 | 1204330 | 1203563 | nucleotide-binding protein {*Homo sapiens*} | | 47.5 | 68.0 | 768 |
| Amino acids; peptides and amines | | | | | | | |
| MJ0609 | 933328 | 934587 | amino acid transporter {*Arabidopsis thaliana*} | | 21.9 | 48.7 | 1260 |
| MJ1343 | 181359 | 182519 | ammonium transport protein AMT1 {*Arabidopsis thaliana*} | | 35.6 | 53.3 | 1161 |
| MJ0058 | 1413598 | 1414770 | ammonium transporter {*Escherichia coli*} | | 34.2 | 52.2 | 1173 |
| MJ1269 | 258901 | 257993 | branched-chain amino acid transport protein livH {*Escherichia coli*} | | 30.8 | 54.6 | 909 |
| MJ1266 | 261404 | 260577 | branched-chain amino acid transport protein livJ {*Escherichia coli*} | | 28.8 | 55.2 | 828 |
| MJ1270 | 257896 | 256934 | branched-chain amino acid transport protein livM {*Escherichia coli*} | | 28.7 | 52.2 | 963 |
| MJ1196 | 332430 | 333311 | cationic amino acid transporter MCAT-2 {*Mus musculus*} | | 24.6 | 50.6 | 882 |
| MJ0304 | 1185908 | 1186333 | ferripyochelin binding protein {*Pseudomonas aeruginosa*} | | 55.6 | 74.7 | 426 |
| MJ0796 | 752786 | 752118 | glutamine transport ATP-binding protein Q {*Escherichia coli*} | | 47.9 | 67.2 | 669 |
| MJ1267 | 260465 | 259707 | high-affinity branched-chain amino acid transport ATP-binding protein {*Pseudomonas aeruginosa*} | | 34.2 | 60.8 | 759 |

TABLE 1A-continued

| MJ1268 | 259458 | 258973 | high-affinity branched-chain amino acid transport ATP-binding protein {Salmonella typhimurium} | 40.4 | 68.6 | 486 |
|---|---|---|---|---|---|---|
| Anions | | | | | | |
| MJ0412 | 1099862 | 1100608 | nitrate transport ATP-binding protein {Synechococcus sp} | 44.6 | 70.1 | 747 |
| MJ0413 | 1099077 | 1099826 | nitrate transport perinease protein {Synechococcus sp} | 34.2 | 59.4 | 750 |
| MJ1012 | 529685 | 530431 | phosphate transport system ATP-binding protein {Escherichia coli} | 60.9 | 80.7 | 747 |
| MJ1013 | 528941 | 529642 | phosphate transport system permease protein A {Haemophilus influenzae} | 39.6 | 60.5 | 702 |
| MJ1014 | 528397 | 528810 | phosphate transport system permease prdtein C {Haemophilus influenzae} | 40.0 | 66.5 | 414 |
| MJ1009 | 532458 | 533165 | phosphate transport system regulatory protein {Escherichia coli} | 28.5 | 54.6 | 708 |
| MJ1015 | 526871 | 527698 | phosphate-binding protein {Xanthomonas oryzae} | 45.8 | 60.2 | 828 |
| Carbohydrates, organic alcohols, and acids | | | | | | |
| MJ0576 | 960439 | 959399 | malic acid transport protein {Schizosaccharomyces pombe} | 23.8 | 47.9 | 1041 |
| MJ0762 | 786703 | 787524 | malic acid transport protein {Schizosaccharomyces pombe} | 26.5 | 49.3 | 822 |
| MJ0121 | 1354728 | 1355291 | SN-glycerol-3-phosphate transport ATP-binding protein {Escherichia coli} | 33.4 | 51.7 | 564 |
| MJ1319 | 206861 | 205926 | sodium-dependent noradrenaline transporter {Haemophilus influenzae} | 37.8 | 61.0 | 936 |
| Cations | | | | | | |
| MJ1088 | 444480 | 445223 | cobalt transport ATP-binding protein O {Salmonella typhimurium} | 46.1 | 66.6 | 744 |
| MJ1090 | 443372 | 443527 | cobalt transport protein N {Salmonella typhimurium} | 59.1 | 79.6 | 156 |
| MJ1089 | 443778 | 444374 | cobalt transport protein Q {Salmonella typhimurium} | 28.9 | 55.6 | 597 |
| MJ0089 | 1388820 | 1388059 | ferric enterobactin transport ATP-binding protein {Escherichia coli} | 33.1 | 59.6 | 762 |
| MJ0873 | 674824 | 674123 | ferric enterobactin transport ATP-binding protein {Escherichia coli} | 31.5 | 60.3 | 702 |
| MJ0566 | 967842 | 969857 | ferrous iron transport protein B {Escherichia coli} | 35.8 | 61.2 | 2016 |
| MJ0877 | 670239 | 670442 | hemin permease {Haemophilus influenzae} | 27.9 | 62.3 | 204 |
| MJ0087 | 1390284 | 1389385 | hemin permease {Yersinia enterocolitica} | 40.6 | 67.7 | 900 |
| MJ0085 | 1392668 | 1391613 | iron tranport system binding protein {Bacillus subtilis} | 32.9 | 53.3 | 1056 |
| MJ0876 | 670677 | 671498 | iron(III) dicitrate transport system permease protein {Escherichia coli} | 30.8 | 52.8 | 822 |
| MJ1441 | 64080 | 60403 | magnesium chelatase subunit {Arabidopsis thaliana} | 35.3 | 57.3 | 3678 |
| MJ0911 | 628932 | 629972 | magnesium-chelatase subunit {Euglena gracilis} | 54.9 | 73.4 | 1041 |
| MJ1275 | 253661 | 252597 | NA(+)/H(+) antiporter {Enterococcus hirae} | 29.8 | 59.9 | 1065 |
| MJ0672 | 873748 | 874665 | Na$^+$ transporter {Haemophilus influenzae} | 39.3 | 63.1 | 918 |
| MJ1231 | 297233 | 298873 | oxaloacetate decarboxylase, alpha subunit {Salmonella typhimurium} | 52.0 | 68.7 | 1641 |
| MJ1357 | 164247 | 165065 | putative potassium channel protein {Bacillus cereus} | 42.9 | 66.7 | 819 |
| MJ1367 | 154669 | 155559 | sulfate permease (cysA) {Synechococcus sp} | 38.5 | 64.5 | 891 |
| MJ1368 | 153995 | 154666 | sulfate/thiosulfate transport protein {Escherichia coli} | 30.9 | 59.4 | 672 |
| MJ1485 | 16909 | 15713 | TRK system potassium uptake protein {Escherichia coli} | 29.5 | 58.5 | 1197 |
| MJ1105 | 426702 | 427217 | TRK system potassium uptake protein A {Methanosarcina mazei} | 39.3 | 57.6 | 516 |
| Other | | | | | | |
| MJ1142 | 390844 | 389885 | arsenical pump-driving ATPase {Escherichia coli} | 34.7 | 55.9 | 960 |
| MJ0822 | 727897 | 729522 | ATPase, vanadate-senstive {Methanococcus voltae} | 48.1 | 69.0 | 1626 |
| MJ0718 | 820399 | 821523 | chromate resistance protein A {Alcaligenes eutrophus} | 27.9 | 52.4 | 1125 |
| MJ1226 | 304219 | 301988 | H$^+$-transporting ATPase {Arabidopsis thaliana} | 45.1 | 63.7 | 2232 |
| MJ1560 | 1600958 | 1601974 | quinolone resistance norA protein protein {Staphylococcus aureus} | 28.8 | 51.1 | 1017 |
| Other-categories | | | | | | |
| MJ1365 | 157333 | 156458 | pheromone shutdown protein {Enterococcus faecalis} | 31.2 | 57.2 | 876 |
| MJECL24 | 28069 | 28845 | SOJ protein {Bacillus subtilis} | 34.0 | 62.1 | 776 |
| Drug and analog sensitivity | | | | | | |
| MJ1538 | 1621434 | 1620691 | K. lactis toxin sensitivity protein KTI12 {Saccharomyces cerevisiae} | 28.4 | 48.8 | 744 |
| MJ0102 | 1375563 | 1375859 | phenylacrylic acid decarboxylase {Saccharomyces cerevisiae} | 50.0 | 74.0 | 297 |
| Phage-related functions and prophages | | | | | | |
| MJ0630 | 915023 | 914598 | sodium-dependent phosphate transporter {Cricetulus griseus} | 32.6 | 60.8 | 426 |

TABLE 1A-continued

Transposon-related functions

| | | | | | | |
|---|---|---|---|---|---|---|
| MJ0367 | 1138754 | 1138080 | integrase {*Weeksella zoohelcum*} | 30.9 | 54.4 | 675 |
| MJ0017 | 1455555 | 1454946 | transposase {*Bacillus thuringiensis*} | 29.5 | 55.0 | 610 |

Other

| | | | | | | |
|---|---|---|---|---|---|---|
| MJ1064 | 466505 | 467095 | acetyltransferase {*Escherichia coli*} | 47.0 | 62.4 | 591 |
| MJ1612 | 1549430 | 1548297 | BcpC phosphonopyruvate decarboxylase {*Streptomyces hygroscopicus*} | 31.1 | 48.9 | 1134 |
| MJ0677 | 868213 | 869160 | ethylene-inducible protein homolog {*Hevea brasiliensis*} | 68.3 | 81.0 | 948 |
| MJ0534 | 1003199 | 1002072 | flavoprotein {*Methanobacterium thermoautotrophicum*} | 34.6 | 57.2 | 1128 |
| MJ0748 | 797504 | 798673 | flavoprotein {*Methanobacterium thermoautotrophicum*} | 67.0 | 82.6 | 1170 |
| MJ0256 | 1230191 | 1229760 | fom2 phosphonopyruvate decarboxylase {*Streptomyces wedmorensis*} | 36.7 | 58.5 | 432 |
| MJ1682 | 1472535 | 1473320 | heat shock protein X {*Haemophilus influenzae*} | 30.4 | 55.5 | 786 |
| MJ0866 | 682753 | 682367 | HIT protein, member of the HIT-family {*Saccharomyces cerevisiae*} | 39.4 | 64.8 | 387 |
| MJ0294 | 1193529 | 1195817 | large helicase related protein, LHR {*Escherichia coli*} | 31.4 | 53.6 | 2289 |
| MJ0010 | 1460660 | 1459497 | phosphonopyruvate decarboxylase {*Streptomyces hygroscopicus*} | 28.0 | 47.2 | 1164 |
| MJ0734 | 805855 | 806439 | rubrerythrin {*Clostridium perfringens*} | 48.9 | 69.2 | 585 |
| MJ0559 | 978287 | 977490 | surE survival protein {*Escherichia coli*} | 34.7 | 55.6 | 798 |
| MJ1100 | 431754 | 430489 | urease operon protein {*Mycobacterium leprae*} | 33.2 | 55.0 | 1266 |
| MJ0543 | 990687 | 991100 | Wilm's tumor suppressor homolog {*Arabidopsis thaliana*} | 45.6 | 64.9 | 414 |
| MJ0765 | 784011 | 785549 | [6Fe-65] prismane-containing protein {*Desulfovibrio desulfuricans*} | 60.2 | 72.8 | 1539 |

Hypothetical

| | | | | | | |
|---|---|---|---|---|---|---|
| MJ0458 | 1063165 | 1062518 | hypothetical protein {*Sulfolobus acidocaldarius*} | -0.9 | -0.9 | 648 |
| MJ0483 | 1047280 | 1048250 | hypothetical protein {*Saccharomyces cerevisiae*} | 27.7 | 48.7 | 971 |
| MJ0920 | 620866 | 621357 | hypothetical protein {*Mycoplasma genitalium*} | 28.3 | 51.3 | 492 |
| MJ0443 | 1074680 | 1075348 | hypothetical protein {*Saccharomyces cerevisiae*} | 27.8 | 52.8 | 669 |
| MJ0144 | 1330246 | 1330962 | hypothetical protein {*Methanobacterium thermoautotrophicum*} | 33.4 | 58.6 | 717 |
| MJ0044 | 1426552 | 1427241 | hypothetical protein (GP:D38561_6) {*Streptomyces wedmorensis*} | 24.1 | 49.8 | 690 |
| MJ0868 | 680710 | 681000 | hypothetical protein (GP:D63999_31) {*Synechocystis sp.*} | 42.2 | 65.0 | 291 |
| MJ1502 | 1662923 | 1663714 | hypothetical protein (GP:D64001_24) {*Synechocystis sp.*} | 36.4 | 60.1 | 792 |
| MJ1129 | 402152 | 402382 | hypothetical protein (GP:D64001_53) {*Synechocystis sp.*} | 37.5 | 57.9 | 231 |
| MJ0057 | 1414899 | 1416176 | hypothetical protein (GP:D64003_36) {*Synechocystis sp.*} | 28.4 | 53.2 | 1278 |
| MJ1335 | 187757 | 187593 | hypothetical protein (GP:D64004_11) {*Synechocystis sp.*} | 46.2 | 63.5 | 165 |
| MJ0640 | 902502 | 903458 | hypothetical protein (GP:D64005_53) {*Synechocystis sp.*} | 33.9 | 58.8 | 957 |
| MJ1347 | 177726 | 177280 | hypothetical protein (GP:D64006_36) {*Synechocystis sp.*} | 32.1 | 58.6 | 447 |
| MJ0392 | 1116428 | 1115556 | hypothetical protein (GP:D64006_95) {*Synechocystis sp.*} | 29.1 | 54.3 | 873 |
| MJ0590 | 950234 | 948222 | hypothetical protein (GP:D64044_18) {*Escherichia coli*} | 30.6 | 52.6 | 2013 |
| MJ1178 | 355642 | 355956 | hypothetical protein (GP:L47709_14) {*Bacillus subtilis*} | 27.1 | 55.3 | 315 |
| MJ0438 | 1080099 | 1079128 | hypothetical protein (GP:L47838_15) {*Bacillus subtilis*} | 29.6 | 55.8 | 972 |
| MJ0644 | 898810 | 898223 | hypothetical protein (GP:M18279_1) {*Pseudomonas sp.*} | 28.3 | 53.4 | 588 |
| MJ0828 | 723763 | 723668 | hypothetical protein (GP:M35130_5) {M71467 M71468} | 58.1 | 87.1 | 96 |
| MJ1526 | 1632280 | 1632810 | hypothetical protein (GP:M36534_1) {*Methanobrevibacter smithii*} | 42.6 | 66.5 | 531 |
| MJ0888 | 652964 | 653473 | hypothetical protein (GP:U00011_3) {*Mycobacterium leprae*} | 29.5 | 51.4 | 510 |
| MJ0729 | 809665 | 809321 | hypothetical protein (GP:U18744_1) {*Bacillus firmus*} | 29.4 | 56.9 | 345 |
| MJ0787 | 761402 | 760077 | hypothetical protein (GP:U19363_11) {*Methanobacterium thermoautotrophicum*} | 49.9 | 71.9 | 1326 |
| MJ0693 | 852445 | 853059 | hypothetical protein (GP:U19363_2) {*Methanobacterium thermoautotrophicum*} | 42.8 | 61.9 | 615 |
| MJ0489 | 1039414 | 1038686 | hypothetical protein (GP:U19363_4) {*Methanobacterium thermoautotrophicum*} | 41.3 | 57.5 | 729 |
| MJ0446 | 1072662 | 1071784 | hypothetical protein (GP:U19363_5) {*Methanobacterium thermoautotrophicum*} | 29.8 | 50.7 | 879 |
| MJ0076 | 1400741 | 1400403 | hypothetical protein (GP:U19364_10) {*Methanobacterium thermoautotrophicum*} | 25.3 | 56.1 | 339 |
| MJ0034 | 1435995 | 1436921 | hypothetical protein (GP:UI9364_2) {*Methanobacterium thermoautotrophicum*} | 23.9 | 49.7 | 927 |
| MJ1251 | 277892 | 277392 | hypothetical protein (GP:UI9364_4) {*Methanobacterium thermoautotrophicum*} | 37.8 | 61.0 | 501 |
| MJ0927 | 615224 | 615694 | hypothetical protein (GP:U19364_6) {*Methanobacterium thermoautotrophicum*} | 37.9 | 57.2 | 471 |
| MJ0785 | 763999 | 762923 | hypothetical protein (GP:U19364_8) {*Methanobacterium thermoautotrophicum*} | 57.5 | 76.6 | 1077 |
| MJ0746 | 799630 | 799935 | hypothetical protein (GP:U21086_2) {*Methanobacterium thermoautotrophicum*} | 60.3 | 76.4 | 306 |
| MJ1155 | 378926 | 380485 | hypothetical protein (GP:W28377_114) {*Escherichia coli*} | 40.0 | 63.7 | 1560 |
| MJ0653 | 890904 | 890359 | hypothetical protein (GP:U31567_2) {*Methanopyrus kandleri*} | 42.2 | 64.8 | 546 |
| MJ0532 | 1003608 | 1004750 | hypothetical protein (GP:U32666_1) {*Methanosarcina barkeri*} | 39.3 | 59.5 | 1143 |
| MJ0674 | 872153 | 871623 | hypothetical protein (GP:X83963_2) {*Thermococcus litoralis*} | 58.3 | 76.7 | 531 |
| MJ1552 | 1608984 | 1608592 | hypothetical protein (GP:X85250_3) {*Pyrococcus furiosus*} | 48.5 | 68.0 | 393 |
| MJ0709 | 837195 | 835996 | hypothetical protein (GP:X91006_2) {*Pyrococcus sp.*} | 25.1 | 50.5 | 1200 |
| MJ0226 | 1255943 | 1255389 | hypothetical protein (GP:Z49569_1) {*Saccharomyces cerevisiae*} | 39.0 | 60.6 | 555 |
| MJ1476 | 25468 | 24851 | hypothetical protein (HI0380) {*Haemophilus influenzae*} | 39.7 | 62.6 | 618 |
| MJ0441 | 1076859 | 1076125 | hypothetical protein (HI0902) {*Haemophilus influenzae*} | 29.2 | 51.1 | 735 |
| MJ1372 | 151434 | 150760 | hypothetical protein (HI0920) {*Haemophilus influenzae*} | 46.7 | 67.5 | 675 |
| MJ0931 | 611416 | 610298 | hypothetical protein (MG372) {*Mycoplasma genitalium*} | 34.9 | 59.9 | 1119 |
| MJ0861 | 687240 | 688532 | hypothetical protein (MG423) {*Mycoplasma genitalium*} | 33.9 | 53.9 | 1293 |
| MJ1252 | 277977 | 278609 | hypothetical protein (PIR:B48653) {*Lactococcus lactis*} | 32.5 | 47.2 | 633 |
| MJ0279 | 1206983 | 1206147 | hypothetical protein (PIR:S01072) {*Desulfurococcus mobilis*} | 29.2 | 53.4 | 837 |
| MJ0299 | 1189620 | 1190600 | hypothetical protein (PIR:S11602) {*Thermoplasma acidophilum*} | 62.1 | 76.6 | 981 |
| MJ1208 | 320842 | 319766 | hypothetical protein (PIR:S21569) {*Metbanobacterium thermoautotrophicum*} | 55.4 | 74.8 | 1077 |
| MJ1533 | 1625982 | 1627727 | hypothetical protein (PIR:S28724) {*Methanococcus vannielii*} | 67.3 | 83.3 | 1746 |
| MJ0323 | 1172727 | 1172276 | hypothetical protein (PIR:S38467) {*Desulfurococcus mobilis*} | 60.7 | 71.7 | 471 |
| MJ1162 | 368773 | 369060 | hypothetical protein (PIR:S41581) {*Methanothermus fervidus*} | 48.3 | 67.7 | 288 |
| MJ0922 | 619284 | 619598 | hypothetical protein (PIR:S41583) {*Methanothermus fervidus*} | 48.6 | 73.4 | 315 |
| MJ0867 | 681124 | 682371 | hypothetical protein (PIR:S49379) {*Pseudomonas aeruginosa*} | 28.7 | 55.2 | 1248 |
| MJ0047 | 1423924 | 1424988 | hypothetical protein (PIR:S51413) {*Saccharomyces cerevisiae*} | 26.9 | 49.9 | 1065 |

TABLE 1A-continued

| | | | | | | | |
|---|---|---|---|---|---|---|---|
| MJ1236 | 290570 | 292111 | hypothetical protein (PIR:S51413) {Saccharomyces cerevisiae} | 33.9 | 54.6 | 1542 |
| MJ0162 | 1306782 | 1305562 | hypothetical protein (PIR:S51413) {Saccharomyces cerevisiae} | 32.4 | 56.4 | 1221 |
| MJ0928 | 614493 | 614957 | hypothetical protein (PIR:S51868) {Saccharomyces cerevisiae} | 38.4 | 61.7 | 465 |
| MJ1625 | 1535098 | 1533113 | hypothetical protein (PIR:S52522) {Saccharomyces cerevisiae} | 27.6 | 50.4 | 1986 |
| MJ0862 | 686185 | 687054 | hypothetical protein (PIR:S52979) {Erwinia herbicola} | 35.5 | 59.2 | 870 |
| MJ1432 | 69872 | 69453 | hypothetical protein (PIR:S53543) {Saccharomyces cerevisiae} | 38.5 | 66.0 | 420 |
| MJ0710 | 835912 | 834914 | hypothetical protein (SP:P05409) {Methanococcus thermolithotrophicus} | 59.2 | 79.9 | 999 |
| MJ0170 | 1299322 | 1300185 | hypothetical protein (SP:P11666) {Escherichia coli} | 30.1 | 54.8 | 864 |
| MJ1593 | 1571988 | 1571740 | hypothetical protein (SP:P12049) {Bacillus subtilis} | 40.3 | 69.6 | 249 |
| MJ0463 | 1060127 | 1059819 | hypothetical protein (SP:P14021) {Methanococcus vannielii} | 78.5 | 92.2 | 309 |
| MJ0464 | 1059719 | 1059435 | hypothetical protein (SP:P14022) {Methanococcus vannielii} | 58.8 | 79.4 | 285 |
| MJ0136 | 1340892 | 1340105 | hypothetical protein (SP:P14027) {Methanococcus vannielii} | 63.4 | 87.8 | 788 |
| MJ0388 | 1118696 | 1119244 | hypothetical protein (SP:P15886) {Methanococcus vannielii} | 46.9 | 66.3 | 549 |
| MJ1225 | 305183 | 304425 | hypothetical protein (SP:P15889) {Thermofilum pendens} | 24.1 | 53.9 | 759 |
| MJ1133 | 398771 | 397509 | hypothetical protein (SP:P22349) {Methanobrevibacter smithii} | 45.9 | 67.4 | 1263 |
| MJ1273 | 255725 | 254676 | hypothetical protein (SP:P25125) {Thermus aquaticus} | 41.4 | 60.2 | 1050 |
| MJ1426 | 76255 | 75812 | hypothetical protein (SP:P25768) {Methanobacterium ivanovii} | 47.3 | 69.3 | 444 |
| MJ0549 | 986782 | 986360 | hypothetical protein (SP:P28910) {Escherichia coli} | 33.9 | 59.3 | 423 |
| MJ0982 | 557497 | 558078 | hypothetical protein (SP:P29202) {Haloarcula marismortui} | 55.9 | 75.4 | 582 |
| MJ0990 | 552446 | 552658 | hypothetical protein (SP:P31065) {Escherichia coli,} | 39.2 | 62.4 | 213 |
| MJ0326 | 1170026 | 1168809 | hypothetical protein (SP:P31466) {Escherichia coli} | 45.6 | 71.7 | 1218 |
| MJ0812 | 736053 | 736679 | hypothetical protein (SP:P31473) {Escherichia coli} | 25.8 | 54.3 | 627 |
| MJ0079 | 1398567 | 1399694 | hypothetical protein (SP:P31473) {Escherichia coli} | 38.0 | 63.3 | 1128 |
| MJ1586 | 1578018 | 1576645 | hypothetical protein (SP:P31806) {Escherichia coli} | 32.4 | 52.1 | 1434 |
| MJ1124 | 409920 | 406336 | hypothetical protein (SP:P32639) {Saccharomyces cerevisiae} {Saccharomyces cerevisiae} | 26.9 | 51.5 | 3585 |
| MJ1081 | 451124 | 450726 | hypothetical protein (SP:P32698) {Escherichia coli} | 38.2 | 62.8 | 399 |
| MJ1413 | 97390 | 97629 | hypothetical protein (SP:P33382) {Listeria monocytogenes} | 40.0 | 60.0 | 240 |
| MJ1170 | 362086 | 361820 | hypothetical protein (SP:P33382) {Listeria monocytogenes} | 42.2 | 63.9 | 267 |
| MJ0051 | 1419978 | 1419670 | hypothetical protein (SP:P34222) {Saccharomyces cerevisiae} | 38.5 | 55.8 | 309 |
| MJ1523 | 1636316 | 1635945 | hypothetical protein (SP:P37002) {Escherichia coli} | 43.0 | 65.0 | 372 |
| MJ0608 | 934974 | 935750 | hypothetical protein (SP:P37487) {Bacillus subtilis} | 44.3 | 71.4 | 777 |
| MJ1661 | 1493414 | 1493809 | hypothetical protein (SP:P37528) {Bacillus subtilis} | 47.0 | 72.6 | 396 |
| MJ1582 | 1580646 | 1579909 | hypothetical protein (SP:P37545) {Bacillus subtilis} | 35.4 | 60.6 | 738 |
| MJ1375 | 148221 | 149408 | hypothetical protein (SP:P37555) {Bacillus subtilis} | 25.0 | 48.6 | 1188 |
| MJ0231 | 1249786 | 1250814 | hypothetical protein (SP:P37869) {Bacillus subtilis} | 40.0 | 44.0 | 1029 |
| MJ0882 | 664582 | 663910 | hypothetical protein (SP:P37872) {Bacillus subtilis} | 44.0 | 68.7 | 673 |
| MJ0043 | 1429606 | 1427252 | hypothetical protein (SP:P38423) {Bacillus subtilis} {Bacillus subtilis} | 45.5 | 58.4 | 2355 |
| MJ0048 | 1422159 | 1422842 | hypothetical protein (SP:P38619) {Sulfolobus acidocaldarius} | 36.6 | 59.1 | 684 |
| MJ0989 | 552670 | 553011 | hypothetical protein (SP:P39164) {Escherichia coli} | 29.0 | 51.8 | 342 |
| MJ1115 | 415733 | 416479 | hypothetical protein (SP:P39364) {Eschenchia coli} | 27.1 | 48.3 | 747 |
| MJ1649 | 1506277 | 1507068 | hypothetical protein (SP:P39587) {Bacillus subtilis} | 28.9 | 48.5 | 792 |
| MJ0577 | 959388 | 958903 | hypothetical protein (SP:P42297) {Bacillus subtilis} | 31.6 | 56.4 | 486 |
| MJ0531 | 1004977 | 1004759 | hypothetical protein (SP:P42297) {Bacillus subtilis} | 43.3 | 68.7 | 219 |
| MJ1247 | 282030 | 281677 | hypothetical protein (SP:P42404) {Bacillus subtilis} | 38.4 | 60.0 | 354 |
| MJ0486 | 1041905 | 1042681 | hypothetical protein (SP:P45476) {Escherichia coli} | 30.6 | 55.7 | 777 |
| MJ0449 | 1070080 | 1069565 | hypothetical protein (SP:P46348) {Bacillus subtilis} | 31.8 | 60.7 | 516 |
| MJ0682 | 861537 | 864374 | hypothetical protein (SP:P46850) {Escherichia coli} | 33.4 | 53.9 | 2838 |
| MJ1677 | 1476726 | 1476376 | hypothetical protein (SP:P46851) {Escherichia coli} | 40.3 | 62.0 | 351 |
| MJ0588 | 951068 | 952243 | hypothetical protein GP:L07942_2 {Escherichia coli} | 31.1 | 55.0 | 1176 |
| MJ0225 | 1256840 | 1256121 | hypothetical protein GP:U00014_23 {Mycobacterium leprae} | 27.4 | 49.0 | 720 |
| MJ0134 | 1342043 | 1342792 | hypothetical protein GP:U00017_21{Mycobacterium leprae} | 32.2 | 52.7 | 750 |
| MJ0376 | 1130650 | 1129136 | hypothetical proiein GP:U29579_58 {Escherichia coli} | 30.1 | 51.5 | 1521 |
| MJ0028 | 1443023 | 1443844 | hypothetical protein HI1305 {Haemophilus influenzae} | 27.0 | 50.0 | 822 |
| MJ1136 | 395844 | 394486 | hypothetical protein Lpg22p (GP:U43281_22) {Saccharomyces cerevisiae} | 46.2 | 63.8 | 1359 |
| MJ0952 | 588063 | 588479 | hypothetical protein PIR:S49633 {Saccharomyces cerevisiae} | 26.8 | 55.0 | 417 |
| MJ0403 | 1109067 | 1108276 | hypothetical protein PIR:S55196 {Saccharomyces cerevisiae} | 27.6 | 48.2 | 792 |
| MJ1031 | 509420 | 508506 | hypothetical protein SP:P45869 {Bacillus subtilis} | 26.8 | 51.1 | 915 |

TABLE 1B

| | | | | | | |
|---|---|---|---|---|---|---|
| MJ0479 | 1,050,508 | 1,049,948 | adenylate kinase {Methanococcus jannaschii} | 100.0% | 100.0% | 585 |

TABLE 2

| | | |
|---|---|---|
| MJ0002 | 4071 | 3343 |
| MJ0003 | 4911 | 5378 |
| MJ0008 | 10075 | 10734 |
| MJ0009 | 10743 | 11570 |
| MJ0011 | 12983 | 13459 |
| MJ0012 | 13927 | 13427 |
| MJ0013 | 14836 | 14351 |
| MJ0014 | 15455 | 14820 |
| MJ0015 | 15514 | 15804 |
| MJ0016 | 16416 | 15866 |
| MJ0018 | 17658 | 19229 |
| MJ0019 | 21121 | 19232 |
| MJ0021 | 22762 | 23886 |
| MJ0023 | 25284 | 25637 |
| MJ0024 | 26105 | 25689 |
| MJ0025 | 27122 | 26109 |
| MJ0027 | 28572 | 28021 |
| MJ0037 | 38073 | 38786 |
| MJ0038 | 39443 | 38793 |
| MJ0039 | 39974 | 39654 |

TABLE 2-continued

| | | |
|---|---|---|
| MJ0041 | 41838 | 40477 |
| MJ0042 | 42527 | 41883 |
| MJ0045 | 46506 | 45907 |
| MJ0046 | 47351 | 46569 |
| MJ0050 | 52237 | 51050 |
| MJ0052 | 53374 | 52709 |
| MJ0053 | 54068 | 53388 |
| MJ0054 | 55001 | 54159 |
| MJ0056 | 56154 | 55759 |
| MJ0062 | 60618 | 61238 |
| MJ0063 | 61322 | 61855 |
| MJ0064 | 61897 | 62454 |
| MJ0065 | 63551 | 62463 |
| MJ0066 | 65078 | 63657 |
| MJ0067 | 65160 | 65468 |
| MJ0068 | 65861 | 65517 |
| MJ0070 | 66966 | 67211 |
| MJ0071 | 67211 | 67480 |
| MJ0072 | 67562 | 67693 |
| MJ0073 | 67729 | 68007 |
| MJ0074 | 69089 | 68016 |
| MJ0075 | 70324 | 69236 |
| MJ0077 | 71539 | 70394 |
| MJ0078 | 72674 | 72054 |
| MJ0080 | 74182 | 73802 |
| MJ0086 | 80788 | 81903 |
| MJ0088 | 83019 | 83537 |
| MJ0093 | 88517 | 88092 |
| MJ0094 | 89481 | 88564 |
| MJ0095 | 89828 | 89568 |
| MJ0096 | 90752 | 89967 |
| MJ0100 | 94823 | 93297 |
| MJ0103 | 97958 | 99256 |
| MJ0105 | 101649 | 101239 |
| MJ0106 | 102541 | 101840 |
| MJ0107 | 102733 | 104295 |
| MJ0109 | 106419 | 105664 |
| MJ0110 | 106880 | 106614 |
| MJ0114 | 111874 | 112782 |
| MJ0115 | 113249 | 112785 |
| MJ0116 | 113931 | 113257 |
| MJ0119 | 116397 | 115726 |
| MJ0120 | 117070 | 116372 |
| MJ0123 | 119524 | 119195 |
| MJ0125 | 123378 | 123031 |
| MJ0126 | 123685 | 123392 |
| MJ0127 | 124034 | 123672 |
| MJ0128 | 124341 | 124048 |
| MJ0129 | 124487 | 124996 |
| MJ0131 | 126783 | 126475 |
| MJ0133 | 129427 | 128609 |
| MJ0137 | 134976 | 134119 |
| MJ0138 | 136566 | 135121 |
| MJ0139 | 136616 | 138244 |
| MJ0140 | 139150 | 139539 |
| MJ0141 | 139529 | 139825 |
| MJ0142 | 139797 | 140237 |
| MJ0145 | 142991 | 142188 |
| MJ0146 | 143409 | 143203 |
| MJ0147 | 144813 | 143701 |
| MJ0149 | 146003 | 145830 |
| MJ0150 | 146069 | 146587 |
| MJ0154 | 152143 | 152589 |
| MJ0157 | 159807 | 160085 |
| MJ0158 | 160155 | 161276 |
| MJ0159 | 163046 | 161430 |
| MJ0163 | 167378 | 166818 |
| MJ0164 | 168614 | 167430 |
| MJ0165 | 169394 | 168627 |
| MJ0166 | 170194 | 169430 |
| MJ0173 | 175871 | 176341 |
| MJ0175 | 178089 | 177475 |
| MJ0181 | 182625 | 181918 |
| MJ0182 | 183311 | 182730 |
| MJ0183 | 183491 | 183348 |
| MJ0184 | 183606 | 183827 |
| MJ0185 | 183886 | 184032 |
| MJ0187 | 185874 | 185440 |
| MJ0188 | 186674 | 185880 |
| MJ0198 | 191384 | 192259 |
| MJ0201 | 193486 | 193007 |
| MJ0202 | 193687 | 194454 |
| MJ0206 | 198871 | 198467 |
| MJ0207 | 198967 | 199419 |
| MJ0208 | 200166 | 199429 |
| MJ0209 | 200956 | 200159 |
| MJ0212 | 203759 | 204019 |
| MJ0213 | 204137 | 204583 |
| MJ0215 | 205636 | 205190 |
| MJ0223 | 214474 | 214163 |
| MJ0224 | 215072 | 214566 |
| MJ0227 | 218176 | 219099 |
| MJ0229 | 221136 | 220852 |
| MJ0230 | 221386 | 221144 |
| MJ0233 | 224281 | 225111 |
| MJ0235 | 226124 | 226369 |
| MJ0236 | 226362 | 227639 |
| MJ0239 | 230506 | 230988 |
| MJ0240 | 231618 | 231094 |
| MJ0241 | 232062 | 231628 |
| MJ0243 | 232563 | 232318 |
| MJ0248 | 235142 | 235651 |
| MJ0251 | 238728 | 238288 |
| MJ0252 | 238849 | 239487 |
| MJ0255 | 241359 | 240607 |
| MJ0257 | 242764 | 243696 |
| MJ0258 | 245039 | 243840 |
| MJ0259 | 245717 | 245112 |
| MJ0261 | 247082 | 246423 |
| MJ0263 | 251686 | 250727 |
| MJ0270 | 256421 | 256188 |
| MJ0271 | 256902 | 257441 |
| MJ0272 | 257452 | 257649 |
| MJ0273 | 258107 | 258412 |
| MJ0274 | 260378 | 258819 |
| MJ0275 | 261121 | 260516 |
| MJ0280 | 266375 | 266758 |
| MJ0281 | 267291 | 266761 |
| MJ0282 | 267341 | 267787 |
| MJ0284 | 269902 | 269174 |
| MJ0286 | 270849 | 270499 |
| MJ0287 | 271160 | 270870 |
| MJ0288 | 271755 | 271222 |
| MJ0289 | 272805 | 271801 |
| MJ0290 | 273753 | 273121 |
| MJ0292 | 275409 | 275137 |
| MJ0296 | 279767 | 280360 |
| MJ0297 | 281155 | 280406 |
| MJ0298 | 281290 | 281739 |
| MJ0301 | 285101 | 284220 |
| MJ0303 | 285971 | 285558 |
| MJ0305 | 286594 | 287778 |
| MJ0306 | 287997 | 287818 |
| MJ0308 | 289084 | 288386 |
| MJ0310 | 290609 | 290268 |
| MJ0311 | 290981 | 290652 |
| MJ0312 | 291845 | 291228 |
| MJ0314 | 293767 | 294369 |
| MJ0315 | 294826 | 294455 |
| MJ0316 | 295458 | 294964 |
| MJ0317 | 296374 | 295733 |
| MJ0319 | 297675 | 297902 |
| MJ0320 | 298001 | 298645 |
| MJ0321 | 298675 | 299040 |
| MJ0325 | 302095 | 301172 |
| MJ0327 | 303625 | 303927 |
| MJ0328 | 304755 | 304318 |
| MJ0329 | 306607 | 304760 |
| MJ0330 | 308266 | 306620 |
| MJ0331 | 308670 | 308266 |
| MJ0332 | 308995 | 308678 |
| MJ0333 | 309670 | 309410 |
| MJ0334 | 309816 | 310112 |
| MJ0335 | 310179 | 310919 |
| MJ0336 | 310932 | 311288 |
| MJ0337 | 311299 | 312084 |
| MJ0338 | 312100 | 312402 |
| MJ0339 | 312374 | 312694 |

TABLE 2-continued

| | | |
|---|---|---|
| MJ0340 | 312697 | 313398 |
| MJ0341 | 313411 | 313770 |
| MJ0342 | 313918 | 314286 |
| MJ0343 | 314270 | 316807 |
| MJ0344 | 316820 | 317359 |
| MJ0345 | 317314 | 318264 |
| MJ0346 | 318277 | 318579 |
| MJ0347 | 318593 | 319045 |
| MJ0348 | 319620 | 321995 |
| MJ0349 | 322367 | 322053 |
| MJ0350 | 322681 | 322418 |
| MJ0351 | 323154 | 322705 |
| MJ0352 | 323901 | 323185 |
| MJ0353 | 324142 | 323891 |
| MJ0354 | 324296 | 324123 |
| MJ0355 | 324661 | 324374 |
| MJ0356 | 324957 | 324697 |
| MJ0357 | 326407 | 325943 |
| MJ0358 | 326796 | 326413 |
| MJ0359 | 327449 | 326808 |
| MJ0360 | 328174 | 327770 |
| MJ0361 | 329502 | 329182 |
| MJ0362 | 329659 | 329847 |
| MJ0364 | 332163 | 332495 |
| MJ0365 | 332503 | 333030 |
| MJ0366 | 333033 | 333308 |
| MJ0368 | 334581 | 334886 |
| MJ0369 | 336040 | 334934 |
| MJ0371 | 337418 | 337639 |
| MJ0374 | 339873 | 338884 |
| MJ0375 | 339920 | 340681 |
| MJ0377 | 343243 | 343752 |
| MJ0378 | 343921 | 344886 |
| MJ0379 | 345500 | 344889 |
| MJ0380 | 345657 | 345974 |
| MJ0381 | 345977 | 346936 |
| MJ0382 | 346955 | 347683 |
| MJ0383 | 347677 | 349518 |
| MJ0384 | 349546 | 350259 |
| MJ0385 | 350252 | 351304 |
| MJ0386 | 351648 | 351307 |
| MJ0390 | 355149 | 354760 |
| MJ0395 | 357787 | 357314 |
| MJ0398 | 359111 | 359923 |
| MJ0400 | 361593 | 362411 |
| MJ0401 | 362717 | 362520 |
| MJ0402 | 363046 | 362729 |
| MJ0404 | 364804 | 364355 |
| MJ0405 | 365385 | 365002 |
| MJ0408 | 367518 | 367880 |
| MJ0409 | 367946 | 370054 |
| MJ0410 | 370074 | 370865 |
| MJ0414 | 374603 | 373419 |
| MJ0415 | 374712 | 375197 |
| MJ0416 | 375222 | 375791 |
| MJ0417 | 376510 | 375800 |
| MJ0418 | 376627 | 377388 |
| MJ0419 | 377369 | 378430 |
| MJ0420 | 378394 | 379533 |
| MJ0421 | 379640 | 380719 |
| MJ0423 | 381855 | 382031 |
| MJ0424 | 382046 | 382336 |
| MJ0425 | 382317 | 382712 |
| MJ0426 | 383243 | 382704 |
| MJ0427 | 383719 | 383243 |
| MJ0431 | 387350 | 387135 |
| MJ0432 | 388127 | 387852 |
| MJ0433 | 388663 | 388139 |
| MJ0434 | 389342 | 388677 |
| MJ0435 | 389620 | 389342 |
| MJ0437 | 391903 | 391667 |
| MJ0439 | 394280 | 393234 |
| MJ0440 | 394492 | 395292 |
| MJ0444 | 398609 | 397740 |
| MJ0447 | 401037 | 400555 |
| MJ0448 | 401168 | 401935 |
| MJ0450 | 403277 | 403834 |
| MJ0452 | 404962 | 404519 |
| MJ0453 | 405287 | 404967 |
| MJ0455 | 406863 | 406285 |
| MJ0456 | 406888 | 407943 |
| MJ0459 | 410088 | 410354 |
| MJ0480 | 422470 | 423063 |
| MJ0481 | 423792 | 424085 |
| MJ0482 | 423793 | 423074 |
| MJ0485 | 427056 | 428102 |
| MJ0488 | 432390 | 432854 |
| MJ0491 | 434681 | 435106 |
| MJ0492 | 435385 | 435101 |
| MJ0494 | 436499 | 436891 |
| MJ0496 | 438482 | 438823 |
| MJ0497 | 439219 | 438821 |
| MJ0498 | 439679 | 439212 |
| MJ0500 | 442304 | 441537 |
| MJ0501 | 442990 | 442394 |
| MJ0504 | 445785 | 446372 |
| MJ0505 | 446365 | 447117 |
| MJ0512 | 453993 | 453292 |
| MJ0513 | 454868 | 454149 |
| MJ0517 | 459731 | 459321 |
| MJ0518 | 460018 | 459737 |
| MJ0519 | 460275 | 460033 |
| MJ0521 | 461746 | 461549 |
| MJ0522 | 462422 | 461769 |
| MJ0523 | 463226 | 462534 |
| MJ0524 | 463697 | 463239 |
| MJ0525 | 463997 | 463839 |
| MJ0526 | 464308 | 464123 |
| MJ0527 | 465146 | 464655 |
| MJ0528 | 465442 | 465149 |
| MJ0529 | 466215 | 465520 |
| MJ0538 | 474805 | 474026 |
| MJ0539 | 476422 | 474833 |
| MJ0540 | 476947 | 476693 |
| MJ0541 | 477507 | 476971 |
| MJ0545 | 483451 | 482711 |
| MJ0546 | 483623 | 483456 |
| MJ0548 | 485032 | 484589 |
| MJ0550 | 487106 | 486012 |
| MJ0551 | 487918 | 487106 |
| MJ0553 | 489383 | 488925 |
| MJ0554 | 490365 | 489910 |
| MJ0556 | 492396 | 491875 |
| MJ0557 | 493186 | 492572 |
| MJ0558 | 493984 | 493202 |
| MJ0560 | 495301 | 494891 |
| MJ0562 | 496903 | 496691 |
| MJ0565 | 502486 | 502046 |
| MJ0567 | 504742 | 504497 |
| MJ0568 | 504847 | 505221 |
| MJ0570 | 506837 | 506112 |
| MJ0572 | 509860 | 510117 |
| MJ0573 | 510262 | 510828 |
| MJ0574 | 510865 | 511143 |
| MJ0575 | 511121 | 511807 |
| MJ0580 | 515428 | 515075 |
| MJ0581 | 515692 | 515937 |
| MJ0582 | 515940 | 516323 |
| MJ0583 | 516393 | 516563 |
| MJ0584 | 516563 | 517657 |
| MJ0585 | 517680 | 518294 |
| MJ0586 | 518563 | 519057 |
| MJ0587 | 519994 | 519536 |
| MJ0589 | 521451 | 521768 |
| MJ0592 | 525620 | 526357 |
| MJ0594 | 526886 | 527392 |
| MJ0596 | 528074 | 528475 |
| MJ0597 | 528539 | 529612 |
| MJ0599 | 530524 | 531120 |
| MJ0602 | 533752 | 532970 |
| MJ0604 | 535443 | 535144 |
| MJ0605 | 535634 | 535443 |
| MJ0606 | 536194 | 535922 |
| MJ0607 | 536435 | 536199 |
| MJ0610 | 540394 | 539093 |
| MJ0614 | 545444 | 545061 |
| MJ0618 | 547877 | 547584 |
| MJ0619 | 549378 | 547861 |

TABLE 2-continued

| | | |
|---|---|---|
| MJ0621 | 551088 | 550573 |
| MJ0623 | 552787 | 553362 |
| MJ0625 | 553606 | 554613 |
| MJ0626 | 554709 | 555335 |
| MJ0627 | 555369 | 555719 |
| MJ0628 | 555715 | 556203 |
| MJ0629 | 556208 | 556849 |
| MJ0632 | 558292 | 559380 |
| MJ0634 | 562682 | 564565 |
| MJ0635 | 564797 | 565636 |
| MJ0638 | 568586 | 567912 |
| MJ0639 | 568870 | 568586 |
| MJ0642 | 571462 | 572451 |
| MJ0645 | 574498 | 574743 |
| MJ0646 | 574757 | 575248 |
| MJ0647 | 575457 | 575296 |
| MJ0648 | 575881 | 575441 |
| MJ0650 | 577458 | 579521 |
| MJ0652 | 580869 | 580471 |
| MJ0659 | 585626 | 586039 |
| MJ0660 | 586366 | 586136 |
| MJ0661 | 587014 | 586496 |
| MJ0662 | 587657 | 587007 |
| MJ0664 | 589291 | 590163 |
| MJ0665 | 590629 | 590180 |
| MJ0668 | 594556 | 594314 |
| MJ0670 | 596945 | 595887 |
| MJ0675 | 601925 | 600753 |
| MJ0678 | 605240 | 604263 |
| MJ0683 | 611696 | 610920 |
| MJ0686 | 615407 | 613668 |
| MJ0687 | 616482 | 615478 |
| MJ0688 | 616670 | 617110 |
| MJ0690 | 617965 | 617375 |
| MJ0691 | 618300 | 617974 |
| MJ0694 | 620244 | 621365 |
| MJ0695 | 621809 | 621486 |
| MJ0696 | 622409 | 621933 |
| MJ0699 | 625837 | 624698 |
| MJ0700 | 625851 | 626822 |
| MJ0701 | 626831 | 628063 |
| MJ0702 | 628050 | 629831 |
| MJ0703 | 629859 | 630536 |
| MJ0704 | 631069 | 632199 |
| MJ0706 | 633440 | 634081 |
| MJ0708 | 634868 | 634425 |
| MJ0711 | 643995 | 644960 |
| MJ0712 | 645967 | 644963 |
| MJ0714 | 648530 | 648880 |
| MJ0716 | 650013 | 650270 |
| MJ0717 | 650815 | 650459 |
| MJ0724 | 657809 | 657189 |
| MJ0730 | 663605 | 663048 |
| MJ0731 | 664213 | 663620 |
| MJ0733 | 665883 | 665521 |
| MJ0737 | 667834 | 667652 |
| MJ0738 | 668149 | 667877 |
| MJ0739 | 668627 | 668175 |
| MJ0742 | 669819 | 669496 |
| MJ0745 | 672208 | 671675 |
| MJ0747 | 673416 | 672961 |
| MJ0749 | 675903 | 675151 |
| MJ0750 | 676710 | 675997 |
| MJ0751 | 677628 | 676795 |
| MJ0752 | 677942 | 677715 |
| MJ0753 | 678766 | 678146 |
| MJ0754 | 679347 | 678775 |
| MJ0755 | 680644 | 679619 |
| MJ0756 | 681296 | 680889 |
| MJ0757 | 682155 | 681424 |
| MJ0758 | 682653 | 682213 |
| MJ0759 | 683029 | 682700 |
| MJ0760 | 683871 | 683047 |
| MJ0761 | 684833 | 684072 |
| MJ0763 | 686251 | 685889 |
| MJ0764 | 686611 | 686264 |
| MJ0766 | 688821 | 688729 |
| MJ0767 | 689531 | 689100 |
| MJ0768 | 689589 | 690335 |
| MJ0769 | 690987 | 690481 |
| MJ0770 | 691651 | 690983 |
| MJ0772 | 692429 | 693487 |
| MJ0773 | 694540 | 694016 |
| MJ0774 | 695228 | 696454 |
| MJ0775 | 696438 | 697379 |
| MJ0776 | 697375 | 698523 |
| MJ0777 | 698474 | 699046 |
| MJ0778 | 699097 | 699603 |
| MJ0779 | 700509 | 699613 |
| MJ0780 | 701537 | 700533 |
| MJ0783 | 706171 | 706737 |
| MJ0786 | 710078 | 710620 |
| MJ0788 | 712303 | 712539 |
| MJ0789 | 712625 | 712972 |
| MJ0790 | 713001 | 713696 |
| MJ0792 | 715511 | 715777 |
| MJ0793 | 716398 | 716931 |
| MJ0794 | 716992 | 717405 |
| MJ0795 | 717488 | 718999 |
| MJ0797 | 720647 | 721759 |
| MJ0798 | 721779 | 722780 |
| MJ0799 | 722786 | 723667 |
| MJ0801 | 725037 | 726173 |
| MJ0802 | 726398 | 726961 |
| MJ0803 | 726984 | 727499 |
| MJ0804 | 727530 | 728387 |
| MJ0805 | 728332 | 728994 |
| MJ0807 | 730149 | 730670 |
| MJ0808 | 730806 | 731804 |
| MJ0809 | 733025 | 733525 |
| MJ0810 | 733584 | 734255 |
| MJ0811 | 735675 | 734359 |
| MJ0815 | 739584 | 738697 |
| MJ0816 | 740542 | 739652 |
| MJ0817 | 741119 | 740502 |
| MJ0818 | 741733 | 741125 |
| MJ0819 | 742225 | 741899 |
| MJ0820 | 742295 | 742191 |
| MJ0821 | 742765 | 742598 |
| MJ0823 | 744830 | 745600 |
| MJ0826 | 747462 | 747875 |
| MJ0830 | 750568 | 750101 |
| MJ0831 | 750950 | 752245 |
| MJ0833 | 758976 | 758239 |
| MJ0834 | 759796 | 759083 |
| MJ0835 | 760901 | 759822 |
| MJ0836 | 762786 | 762430 |
| MJ0837 | 762860 | 763606 |
| MJ0838 | 764466 | 764816 |
| MJ0839 | 765906 | 764857 |
| MJ0840 | 765992 | 766972 |
| MJ0841 | 768225 | 766981 |
| MJ0856 | 780538 | 779996 |
| MJ0857 | 781920 | 781099 |
| MJ0858 | 782318 | 781980 |
| MJ0859 | 782837 | 782355 |
| MJ0865 | 788311 | 789585 |
| MJ0871 | 795055 | 795975 |
| MJ0872 | 797236 | 796022 |
| MJ0874 | 798213 | 798491 |
| MJ0875 | 798611 | 800854 |
| MJ0878 | 803147 | 804388 |
| MJ0880 | 805402 | 806325 |
| MJ0883 | 808397 | 809404 |
| MJ0887 | 818880 | 818209 |
| MJ0889 | 819606 | 821000 |
| MJ0890 | 821429 | 821019 |
| MJ0894 | 824064 | 824486 |
| MJ0895 | 824467 | 825492 |
| MJ0896 | 825552 | 825953 |
| MJ0897 | 825946 | 826362 |
| MJ0898 | 826495 | 826932 |
| MJ0899 | 826954 | 827643 |
| MJ0900 | 827668 | 829308 |
| MJ0901 | 829430 | 830998 |
| MJ0902 | 831028 | 831729 |
| MJ0903 | 831942 | 833855 |
| MJ0904 | 834299 | 834547 |

TABLE 2-continued

| | | |
|---|---|---|
| MJ0905 | 834622 | 834954 |
| MJ0906 | 834959 | 836056 |
| MJ0907 | 836917 | 836072 |
| MJ0909 | 840933 | 841220 |
| MJ0910 | 841954 | 841433 |
| MJ0912 | 843688 | 844416 |
| MJ0914 | 845908 | 845783 |
| MJ0915 | 847507 | 846707 |
| MJ0916 | 847875 | 847609 |
| MJ0917 | 847950 | 849671 |
| MJ0919 | 850996 | 850550 |
| MJ0921 | 852470 | 851571 |
| MJ0923 | 853368 | 854258 |
| MJ0925 | 855529 | 855212 |
| MJ0926 | 856378 | 856638 |
| MJ0933 | 862692 | 863390 |
| MJ0935 | 864824 | 865447 |
| MJ0936 | 865545 | 866042 |
| MJ0938 | 868207 | 867473 |
| MJ0939 | 868278 | 869102 |
| MJ0943 | 875111 | 873870 |
| MJ0944 | 875300 | 875659 |
| MJ0945 | 876358 | 875687 |
| MJ0948 | 881231 | 880668 |
| MJ0949 | 881637 | 881269 |
| MJ0950 | 882370 | 881684 |
| MJ0951 | 883634 | 882570 |
| MJ0953 | 884488 | 884787 |
| MJ0954 | 886106 | 884802 |
| MJ0956 | 887437 | 888216 |
| MJ0957 | 888219 | 889268 |
| MJ0958 | 889276 | 890553 |
| MJ0962 | 894937 | 895320 |
| MJ0966 | 899875 | 901197 |
| MJ0967 | 901940 | 901326 |
| MJ0968 | 901996 | 902814 |
| MJ0969 | 903935 | 903126 |
| MJ0970 | 904627 | 904199 |
| MJ0971 | 904756 | 905844 |
| MJ0972 | 905808 | 906488 |
| MJ0973 | 907728 | 906496 |
| MJ0974 | 908172 | 907741 |
| MJ0975 | 908365 | 908162 |
| MJ0976 | 908463 | 909560 |
| MJ0977 | 909594 | 911000 |
| MJ0978 | 911359 | 911688 |
| MJ0979 | 912309 | 911719 |
| MJ0981 | 914246 | 913641 |
| MJ0986 | 917606 | 917373 |
| MJ0987 | 917909 | 918247 |
| MJ0988 | 918361 | 919347 |
| MJ0991 | 920189 | 920608 |
| MJ0992 | 920924 | 921142 |
| MJ0995 | 924316 | 923636 |
| MJ0997 | 925109 | 925719 |
| MJ0998 | 926425 | 926012 |
| MJ1002 | 930965 | 931891 |
| MJ1004 | 933349 | 933990 |
| MJ1005 | 933994 | 934386 |
| MJ1006 | 934412 | 935437 |
| MJ1010 | 941079 | 939958 |
| MJ1011 | 941860 | 941471 |
| MJ1016 | 946060 | 946941 |
| MJ1017 | 946934 | 947542 |
| MJ1020 | 950418 | 951194 |
| MJ1021 | 951732 | 951244 |
| MJ1022 | 953674 | 951968 |
| MJ1024 | 954536 | 955744 |
| MJ1025 | 956917 | 955751 |
| MJ1028 | 959569 | 961611 |
| MJ1030 | 962492 | 962932 |
| MJ1032 | 963985 | 965082 |
| MJ1034 | 966050 | 966310 |
| MJ1036 | 967587 | 968276 |
| MJ1049 | 986885 | 987367 |
| MJ1050 | 987438 | 987968 |
| MJ1052 | 989793 | 989503 |
| MJ1053 | 990349 | 989861 |
| MJ1060 | 1000457 | 1002067 |
| MJ1067 | 1008238 | 1008681 |
| MJ1069 | 1010805 | 1009630 |
| MJ1070 | 1011399 | 1010929 |
| MJ1071 | 1012337 | 1011399 |
| MJ1072 | 1012709 | 1012362 |
| MJ1073 | 1013688 | 1012879 |
| MJ1074 | 1014135 | 1013800 |
| MJ1076 | 1016646 | 1015636 |
| MJ1077 | 1018245 | 1016683 |
| MJ1078 | 1019039 | 1018338 |
| MJ1079 | 1020506 | 1019316 |
| MJ1080 | 1021091 | 1020687 |
| MJ1082 | 1021657 | 1022016 |
| MJ1083 | 1022089 | 1022667 |
| MJ1085 | 1023633 | 1025159 |
| MJ1086 | 1025159 | 1026178 |
| MJ1092 | 1030102 | 1030743 |
| MJ1094 | 1033051 | 1031897 |
| MJ1095 | 1034350 | 1033088 |
| MJ1098 | 1039265 | 1038627 |
| MJ1099 | 1040323 | 1039619 |
| MJ1103 | 1043990 | 1043727 |
| MJ1106 | 1046606 | 1046052 |
| MJ1107 | 1047073 | 1046627 |
| MJ1110 | 1052574 | 1051117 |
| MJ1111 | 1053691 | 1052540 |
| MJ1112 | 1053818 | 1053645 |
| MJ1114 | 1055795 | 1055220 |
| MJ1117 | 1058450 | 1059037 |
| MJ1118 | 1059065 | 1059331 |
| MJ1120 | 1060339 | 1061175 |
| MJ1121 | 1061532 | 1061251 |
| MJ1122 | 1061729 | 1061508 |
| MJ1123 | 1061809 | 1062423 |
| MJ1125 | 1066578 | 1066399 |
| MJ1126 | 1067325 | 1068140 |
| MJ1127 | 1068204 | 1069043 |
| MJ1128 | 1069964 | 1069050 |
| MJ1132 | 1073401 | 1073048 |
| MJ1134 | 1075567 | 1074881 |
| MJ1137 | 1078625 | 1078035 |
| MJ1138 | 1078694 | 1079215 |
| MJ1139 | 1080031 | 1079336 |
| MJ1140 | 1080732 | 1080049 |
| MJ1141 | 1080810 | 1081406 |
| MJ1143 | 1082498 | 1083604 |
| MJ1144 | 1084575 | 1083607 |
| MJ1145 | 1085112 | 1084918 |
| MJ1147 | 1086431 | 1087786 |
| MJ1150 | 1088688 | 1089230 |
| MJ1151 | 1089352 | 1089681 |
| MJ1152 | 1089693 | 1089902 |
| MJ1153 | 1089902 | 1090087 |
| MJ1154 | 1091598 | 1090246 |
| MJ1157 | 1097614 | 1098636 |
| MJ1158 | 1097631 | 1097245 |
| MJ1159 | 1098676 | 1100610 |
| MJ1161 | 1102129 | 1102629 |
| MJ1163 | 1104052 | 1104747 |
| MJ1164 | 1106045 | 1105095 |
| MJ1172 | 1111539 | 1111781 |
| MJ1173 | 1111785 | 1112066 |
| MJ1177 | 1117451 | 1118467 |
| MJ1179 | 1118839 | 1119285 |
| MJ1180 | 1119545 | 1119979 |
| MJ1181 | 1120081 | 1120677 |
| MJ1182 | 1121087 | 1122184 |
| MJ1183 | 1122200 | 1122670 |
| MJ1184 | 1122741 | 1123160 |
| MJ1185 | 1125032 | 1123167 |
| MJ1186 | 1125194 | 1126231 |
| MJ1188 | 1127047 | 1126238 |
| MJ1189 | 1128908 | 1128060 |
| MJ1198 | 1142323 | 1144605 |
| MJ1199 | 1145059 | 1144631 |
| MJ1205 | 1148679 | 1148371 |
| MJ1206 | 1149937 | 1148675 |
| MJ1207 | 1150577 | 1151254 |
| MJ1209 | 1154047 | 1152613 |

TABLE 2-continued

| | | |
|---|---|---|
| MJ1210 | 1154918 | 1154148 |
| MJ1211 | 1155290 | 1154943 |
| MJ1213 | 1156520 | 1156191 |
| MJ1215 | 1159884 | 1159639 |
| MJ1216 | 1160233 | 1159871 |
| MJ1217 | 1160540 | 1160247 |
| MJ1219 | 1162177 | 1161875 |
| MJ1221 | 1164080 | 1164958 |
| MJ1222 | 1165703 | 1164984 |
| MJ1223 | 1165956 | 1165681 |
| MJ1224 | 1167016 | 1166600 |
| MJ1230 | 1173450 | 1173235 |
| MJ1232 | 1176334 | 1175447 |
| MJ1233 | 1176475 | 1177311 |
| MJ1234 | 1178669 | 1177947 |
| MJ1239 | 1184644 | 1185318 |
| MJ1240 | 1185617 | 1185327 |
| MJ1241 | 1185877 | 1185644 |
| MJ1243 | 1187992 | 1187624 |
| MJ1244 | 1188410 | 1188087 |
| MJ1245 | 1188760 | 1188425 |
| MJ1248 | 1191184 | 1190723 |
| MJ1249 | 1191367 | 1192449 |
| MJ1250 | 1192973 | 1193731 |
| MJ1254 | 1197164 | 1197400 |
| MJ1255 | 1197430 | 1198611 |
| MJ1256 | 1198911 | 1199543 |
| MJ1257 | 1199543 | 1200589 |
| MJ1262 | 1204364 | 1205530 |
| MJ1272 | 1216145 | 1216633 |
| MJ1278 | 1223720 | 1223184 |
| MJ1279 | 1224266 | 1223724 |
| MJ1280 | 1224460 | 1224930 |
| MJ1281 | 1224854 | 1227994 |
| MJ1282 | 1228714 | 1229769 |
| MJ1283 | 1231676 | 1231017 |
| MJ1284 | 1232029 | 1231667 |
| MJ1285 | 1232580 | 1232029 |
| MJ1286 | 1234269 | 1232587 |
| MJ1287 | 1235086 | 1234319 |
| MJ1288 | 1235901 | 1235155 |
| MJ1289 | 1236778 | 1236284 |
| MJ1290 | 1237713 | 1236778 |
| MJ1291 | 1238448 | 1237729 |
| MJ1292 | 1238662 | 1241124 |
| MJ1293 | 1241174 | 1241866 |
| MJ1295 | 1243251 | 1242847 |
| MJ1301 | 1250120 | 1248921 |
| MJ1302 | 1250541 | 1250149 |
| MJ1304 | 1252617 | 1252162 |
| MJ1305 | 1253036 | 1252596 |
| MJ1306 | 1253300 | 1253052 |
| MJ1307 | 1254110 | 1253325 |
| MJ1308 | 1254426 | 1254115 |
| MJ1309 | 1255877 | 1254459 |
| MJ1310 | 1256325 | 1255942 |
| MJ1311 | 1256457 | 1257287 |
| MJ1312 | 1257321 | 1258283 |
| MJ1313 | 1258388 | 1259596 |
| MJ1315 | 1260519 | 1261589 |
| MJ1316 | 1261606 | 1261833 |
| MJ1317 | 1263015 | 1261822 |
| MJ1318 | 1264868 | 1263063 |
| MJ1320 | 1268194 | 1267802 |
| MJ1321 | 1270356 | 1268218 |
| MJ1322 | 1273392 | 1270378 |
| MJ1323 | 1274489 | 1273392 |
| MJ1325 | 1275428 | 1275694 |
| MJ1327 | 1277081 | 1277815 |
| MJ1330 | 1280424 | 1280792 |
| MJ1331 | 1281220 | 1280801 |
| MJ1333 | 1282515 | 1282766 |
| MJ1336 | 1284800 | 1285282 |
| MJ1337 | 1285743 | 1286216 |
| MJ1339 | 1287389 | 1287850 |
| MJ1340 | 1287925 | 1288266 |
| MJ1341 | 1289221 | 1288286 |
| MJ1342 | 1289457 | 1289798 |
| MJ1345 | 1291918 | 1292841 |
| MJ1348 | 1295149 | 1296126 |
| MJ1350 | 1298227 | 1297454 |
| MJ1354 | 1304338 | 1304772 |
| MJ1355 | 1304858 | 1306531 |
| MJ1356 | 1306729 | 1307295 |
| MJ1358 | 1309040 | 1308648 |
| MJ1359 | 1309889 | 1309164 |
| MJ1360 | 1310249 | 1309953 |
| MJ1361 | 1310355 | 1311230 |
| MJ1364 | 1313354 | 1314619 |
| MJ1369 | 1318564 | 1319028 |
| MJ1370 | 1319061 | 1320044 |
| MJ1371 | 1320053 | 1320775 |
| MJ1373 | 1321601 | 1322086 |
| MJ1374 | 1322262 | 1322954 |
| MJ1379 | 1328524 | 1328823 |
| MJ1380 | 1328819 | 1329052 |
| MJ1382 | 1331473 | 1331036 |
| MJ1383 | 1332364 | 1331597 |
| MJ1384 | 1333177 | 1332596 |
| MJ1385 | 1333741 | 1333205 |
| MJ1386 | 1333877 | 1334008 |
| MJ1387 | 1335433 | 1334297 |
| MJ1389 | 1337813 | 1337412 |
| MJ1393 | 1341979 | 1343802 |
| MJ1394 | 1343895 | 1346852 |
| MJ1395 | 1347176 | 1347571 |
| MJ1396 | 1347707 | 1356388 |
| MJ1397 | 1356457 | 1357905 |
| MJ1398 | 1358183 | 1359355 |
| MJ1399 | 1359929 | 1359339 |
| MJ1400 | 1360142 | 1359942 |
| MJ1401 | 1360259 | 1362682 |
| MJ1402 | 1364357 | 1363320 |
| MJ1403 | 1365794 | 1364673 |
| MJ1404 | 1366111 | 1367364 |
| MJ1405 | 1367427 | 1367639 |
| MJ1407 | 1368408 | 1368794 |
| MJ1409 | 1370733 | 1369939 |
| MJ1410 | 1371310 | 1370834 |
| MJ1412 | 1373210 | 1374703 |
| MJ1414 | 1375807 | 1375094 |
| MJ1416 | 1378350 | 1376995 |
| MJ1419 | 1382016 | 1381714 |
| MJ1423 | 1394263 | 1393208 |
| MJ1424 | 1394481 | 1395002 |
| MJ1427 | 1396680 | 1397633 |
| MJ1428 | 1397643 | 1399343 |
| MJ1429 | 1399343 | 1400842 |
| MJ1431 | 1401322 | 1402398 |
| MJ1433 | 1402914 | 1403654 |
| MJ1435 | 1404402 | 1404614 |
| MJ1436 | 1404758 | 1405048 |
| MJ1437 | 1405055 | 1405738 |
| MJ1440 | 1407288 | 1408133 |
| MJ1442 | 1412130 | 1412735 |
| MJ1443 | 1412784 | 1413104 |
| MJ1445 | 1414331 | 1414858 |
| MJ1447 | 1415840 | 1416982 |
| MJ1448 | 1416982 | 1418571 |
| MJ1449 | 1418577 | 1419686 |
| MJ1450 | 1419699 | 1420811 |
| MJ1451 | 1420869 | 1422320 |
| MJ1452 | 1422616 | 1423392 |
| MJ1453 | 1423398 | 1423973 |
| MJ1455 | 1425643 | 1424729 |
| MJ1457 | 1427021 | 1427422 |
| MJ1458 | 1427487 | 1428140 |
| MJ1460 | 1430419 | 1429943 |
| MJ1461 | 1431156 | 1430560 |
| MJ1462 | 1431506 | 1431258 |
| MJ1463 | 1432201 | 1431530 |
| MJ1466 | 1436397 | 1435756 |
| MJ1467 | 1436562 | 1437008 |
| MJ1468 | 1437029 | 1440055 |
| MJ1469 | 1440055 | 1440279 |
| MJ1470 | 1440747 | 1442618 |
| MJ1471 | 1442618 | 1443151 |
| MJ1472 | 1443165 | 1444796 |

TABLE 2-continued

| | | |
|---|---|---|
| MJ1475 | 1446447 | 1446821 |
| MJ1477 | 1447530 | 1448537 |
| MJ1478 | 1449448 | 1448540 |
| MJ1480 | 1451452 | 1452720 |
| MJ1481 | 1452735 | 1453373 |
| MJ1483 | 1454337 | 1454783 |
| MJ1484 | 1454768 | 1455217 |
| MJ1487 | 1459016 | 1460293 |
| MJ1488 | 1460315 | 1461493 |
| MJ1491 | 1465684 | 1466055 |
| MJ1492 | 1466067 | 1466534 |
| MJ1493 | 1466552 | 1467235 |
| MJ1495 | 1468532 | 1469377 |
| MJ1496 | 1469370 | 1469711 |
| MJ1497 | 1469711 | 1470748 |
| MJ1499 | 1472128 | 1471649 |
| MJ1500 | 1472920 | 1472363 |
| MJ1501 | 1473615 | 1472947 |
| MJ1503 | 1474982 | 1474587 |
| MJ1506 | 1479963 | 1478767 |
| MJ1507 | 1480030 | 1481214 |
| MJ1509 | 1482024 | 1482482 |
| MJ1510 | 1483084 | 1482506 |
| MJ1511 | 1483234 | 1483572 |
| MJ1513 | 1489601 | 1488606 |
| MJ1514 | 1489692 | 1490078 |
| MJ1515 | 1490084 | 1491148 |
| MJ1516 | 1491173 | 1491466 |
| MJ1517 | 1492030 | 1492863 |
| MJ1518 | 1492917 | 1493975 |
| MJ1519 | 1494094 | 1497618 |
| MJ1520 | 1498588 | 1497656 |
| MJ1521 | 1498905 | 1500170 |
| MJ1524 | 1501404 | 1501727 |
| MJ1525 | 1501702 | 1504500 |
| MJ1527 | 1505607 | 1505281 |
| MJ1535 | 1512870 | 1513766 |
| MJ1537 | 1515742 | 1514714 |
| MJ1539 | 1516728 | 1517042 |
| MJ1540 | 1517209 | 1517466 |
| MJ1542 | 1521169 | 1518746 |
| MJ1544 | 1523759 | 1522470 |
| MJ1545 | 1523900 | 1524592 |
| MJ1547 | 1525820 | 1526005 |
| MJ1548 | 1526062 | 1526427 |
| MJ1550 | 1527849 | 1528031 |
| MJ1551 | 1528046 | 1528216 |
| MJ1553 | 1528749 | 1529240 |
| MJ1554 | 1529326 | 1531191 |
| MJ1556 | 1532701 | 1533636 |
| MJ1557 | 1533644 | 1534390 |
| MJ1558 | 1534666 | 1534397 |
| MJ1559 | 1534699 | 1535262 |
| MJ1561 | 1538168 | 1536510 |
| MJ1562 | 1539331 | 1538168 |
| MJ1563 | 1539812 | 1539345 |
| MJ1564 | 1540186 | 1540695 |
| MJ1565 | 1540699 | 1542237 |
| MJ1566 | 1543572 | 1542232 |
| MJ1567 | 1544072 | 1543557 |
| MJ1568 | 1544632 | 1544078 |
| MJ1570 | 1545637 | 1545981 |
| MJ1571 | 1546111 | 1546986 |
| MJ1573 | 1548452 | 1548270 |
| MJ1576 | 1551559 | 1552164 |
| MJ1577 | 1552197 | 1553990 |
| MJ1579 | 1555146 | 1554937 |
| MJ1580 | 1555498 | 1555127 |
| MJ1583 | 1557431 | 1557808 |
| MJ1584 | 1558268 | 1557816 |
| MJ1585 | 1559172 | 1558255 |
| MJ1587 | 1560732 | 1561265 |
| MJ1588 | 1561285 | 1561620 |
| MJ1589 | 1561657 | 1562379 |
| MJ1590 | 1562770 | 1563084 |
| MJ1595 | 1567357 | 1566332 |
| MJ1598 | 1572075 | 1571026 |
| MJ1599 | 1572924 | 1572094 |
| MJ1600 | 1573002 | 1573532 |
| MJ1601 | 1573539 | 1574018 |
| MJ1604 | 1578693 | 1577308 |
| MJ1608 | 1582917 | 1583126 |
| MJ1609 | 1583168 | 1584289 |
| MJ1613 | 1589822 | 1589058 |
| MJ1614 | 1590582 | 1589830 |
| MJ1615 | 1591350 | 1590586 |
| MJ1617 | 1593103 | 1593381 |
| MJ1618 | 1593786 | 1593397 |
| MJ1620 | 1594531 | 1596084 |
| MJ1621 | 1596297 | 1596127 |
| MJ1622 | 1597169 | 1597719 |
| MJ1623 | 1597939 | 1599474 |
| MJ1624 | 1599991 | 1599602 |
| MJ1626 | 1602381 | 1600087 |
| MJ1627 | 1604683 | 1604231 |
| MJ1628 | 1606127 | 1604784 |
| MJ1629 | 1607293 | 1606418 |
| MJ1630 | 1610737 | 1607330 |
| MJ1631 | 1611184 | 1612740 |
| MJ1632 | 1612697 | 1613446 |
| MJ1633 | 1614897 | 1613467 |
| MJ1634 | 1615733 | 1615011 |
| MJ1635 | 1615933 | 1617174 |
| MJ1637 | 1618268 | 1619686 |
| MJ1638 | 1620457 | 1619678 |
| MJ1639 | 1620605 | 1621036 |
| MJ1640 | 1621671 | 1621057 |
| MJ1641 | 1622664 | 1621804 |
| MJ1642 | 1623032 | 1623514 |
| MJ1644 | 1627146 | 1627667 |
| MJ1646 | 1628442 | 1629074 |
| MJ1650 | 1632586 | 1631435 |
| MJ1651 | 1633407 | 1632631 |
| MJ1653 | 1635797 | 1636951 |
| MJ1654 | 1637097 | 1637693 |
| MJ1657 | 1639687 | 1640427 |
| MJ1658 | 1640511 | 1640783 |
| MJ1659 | 1640800 | 1641870 |
| MJ1660 | 1641857 | 1643503 |
| MJ1664 | 1646502 | 1647179 |
| MJ1665 | 1648555 | 1647182 |
| MJ1666 | 1650080 | 1648686 |
| MJ1667 | 1651336 | 1650083 |
| MJ1668 | 1652321 | 1651194 |
| MJ1669 | 1653119 | 1652376 |
| MJ1670 | 1653547 | 1653149 |
| MJ1671 | 1653684 | 1653550 |
| MJ1672 | 1656206 | 1653807 |
| MJ1673 | 1656630 | 1656244 |
| MJ1674 | 1658539 | 1656638 |
| MJ1676 | 1659621 | 1660334 |
| MJ1678 | 1660939 | 1662126 |
| MJ1679 | 1662142 | 1662432 |
| MJ1680 | 1662411 | 1662866 |
| MJ1681 | 1663887 | 1662862 |
| MJECS01 | 1268 | 432 |
| MJECS02 | 4814 | 1272 |
| MJECS03 | 5192 | 4851 |
| MJECS04 | 5884 | 5459 |
| MJECS05 | 6365 | 6814 |
| MJECS06 | 7443 | 7009 |
| MJECS07 | 8765 | 7428 |
| MJECS08 | 11950 | 8738 |
| MJECS09 | 12641 | 11925 |
| MJECS10 | 14062 | 13181 |
| MJECS11 | 14404 | 15030 |
| MJECS12 | 16547 | 15411 |
| MJECL01 | 275 | 1048 |
| MJECL02 | 1474 | 1085 |
| MJECL03 | 1700 | 1377 |
| MJECL04 | 1865 | 3250 |
| MJECL05 | 3235 | 3450 |
| MJECL06 | 4170 | 3787 |
| MJECL07 | 5844 | 4561 |
| MJECL08 | 7415 | 5832 |
| MJECL09 | 7780 | 8103 |
| MJECL10 | 8107 | 8784 |
| MJECL11 | 8788 | 9159 |

TABLE 2-continued

| | | |
|---|---|---|
| MJECL12 | 9150 | 9887 |
| MJECL13 | 10678 | 12483 |
| MJECL14 | 14468 | 15427 |
| MJECL15 | 15420 | 16541 |
| MJECL16 | 16599 | 16811 |
| MJECL18 | 20873 | 21505 |
| MJECL19 | 21456 | 22019 |
| MJECL20 | 22829 | 23290 |
| MJECL21 | 24596 | 23298 |
| MJECL22 | 25120 | 24854 |
| MJECL23 | 27628 | 25136 |
| MJECL25 | 28835 | 29167 |
| MJECL26 | 30215 | 29178 |
| MJECL27 | 31077 | 30571 |
| MJECL28 | 35352 | 31534 |
| MJECL30 | 37621 | 37151 |
| MJECL31 | 37811 | 37599 |
| MJECL32 | 40153 | 38828 |
| MJECL33 | 41381 | 40125 |
| MJECL34 | 43121 | 42231 |
| MJECL35 | 45007 | 43115 |
| MJECL36 | 45921 | 45394 |
| MJECL37 | 46065 | 46865 |
| MJECL38 | 47997 | 47197 |
| MJECL39 | 49387 | 48329 |
| MJECL41 | 53908 | 52613 |
| MJECL43 | 57371 | 56187 |
| MJECL44 | 58339 | 57341 |

TABLE 3

Genes of *M. jannaschii* that contain inteins.

| Gene No. | Putative identification | No. of inteins |
|---|---|---|
| MJ0043 | Hypothetical protein (*Bacillus subtilis*) | 1 |
| MJ0262 | Putative translation initiation factor, FUN12/IF-2 family | 1 |
| MJ0542 | Phosphoenolpyruvate synthase | 1 |
| MJ0682 | Hypothetical protein (*Escherichia coli*) | 1 |
| MJ0782 | Transcription initiation factor IIB | 1 |
| MJ0832 | Anaerobic ribonucleoside-triphosphate reductase | 2 |
| MJ0885 | DNA-dependent DNA polymerase, family B | 2 |
| MJ1042 | DNA-dependent RNA polymerase, subunit A' | 1 |
| MJ1043 | DNA-dependent RNA polymerase, subunit A" | 1 |
| MJ1054 | UDP-glucose dehydrogenase | 1 |
| MJ1124 | Hypothetical protein (*Saccharomyces cerevisiae*) | 1 |
| MJ1420 | Glutamine-fructose-6-phosphate transaminase | 1 |
| MJ1422 | Replication factor C, 37-kD subunit | 3 |
| MJ1512 | Reverse gyrase | 1 |

While the present invention has been described in some detail for purposes of clarity and understanding, one skilled in the art will appreciate that various changes in form and detail can be made without departing from the true scope of the invention.

All patents, patent applications and publications recited herein are hereby incorporated by reference.

SEQUENCE LISTING (20 sequences)

SEQ ID NO: 1 - DNA, 1664976 bp, Methanococcus jannaschii
  misc_feature (28222)..(28222): n equals a, t, c, or g
  misc_feature (28257)..(28258): n equals a, t, c, or g
  misc_feature (84773)..(84773): n equals a, t, c, or g
  misc_feature (84808)..(84808): n equals a, t, c, or g
  misc_feature (84812)..(84812): n equals a, t, c, or g
  misc_feature (98120)..(98120): n equals a, t, c, or g
  misc_feature (98159)..(98159): n equals a, t, c, or g
  misc_feature (98239)..(98239): n equals a, t, c, or g
  misc_feature (98266)..(98266): n equals a, t, c, or g
  misc_feature (98343)..(98343): n equals a, t, c, or g
  misc_feature (103998)..(103998): n equals a, t, c, or g
  misc_feature (148948)..(148948): n equals a, t, c, or g
  misc_feature (163385)..(163385): n equals a, t, c, or g
  misc_feature (191989)..(191989): n equals a, t, c, or g
  misc_feature (191995)..(191995): n equals a, t, c, or g
  misc_feature (231980)..(231980): n equals a, t, c, or g
  misc_feature (234187)..(234187): n equals a, t, c, or g
  misc_feature (234220)..(234220): n equals a, t, c, or g
  misc_feature (234814)..(234814): n equals a, t, c, or g
  misc_feature (309398)..(309398): n equals a, t, c, or g
  misc_feature (309418)..(309418): n equals a, t, c, or g
  misc_feature (312837)..(312837): n equals a, t, c, or g
  misc_feature (312993)..(312993): n equals a, t, c, or g
  misc_feature (319226)..(319226): n equals a, t, c, or g
  misc_feature (559167)..(559167): n equals a, t, c, or g
  misc_feature (559241)..(559241): n equals a, t, c, or g
  misc_feature (600992)..(600992): n equals a, t, c, or g
  misc_feature (622708)..(622708): n equals a, t, c, or g
  misc_feature (657081)..(657081): n equals a, t, c, or g
  misc_feature (657203)..(657203): n equals a, t, c, or g
  misc_feature (674435)..(674435): n equals a, t, c, or g
  misc_feature (682442)..(682442): n equals a, t, c, or g
  misc_feature (713652)..(713652): n equals a, t, c, or g
  misc_feature (741684)..(741684): n equals a, t, c, or g
  misc_feature (779455)..(779455): n equals a, t, c, or g
  misc_feature (779676)..(779676): n equals a, t, c, or g
  misc_feature (855539)..(855539): n equals a, t, c, or g
  misc_feature (871619)..(871619): n equals a, t, c, or g
  misc_feature (1084830)..(1084830): n equals a, t, c, or g
  misc_feature (1096846)..(1096846): n equals a, t, c, or g
  misc_feature (1119881)..(1119881): n equals a, t, c, or g
  misc_feature (1130881)..(1130881): n equals a, t, c, or g
  misc_feature (1310988)..(1310988): n equals a, t, c, or g
  misc_feature (1313224)..(1313224): n equals a, t, c, or g
  misc_feature (1349473)..(1349473): n equals a, t, c, or g
  misc_feature (1349491)..(1349491): n equals a, t, c, or g
  misc_feature (1470091)..(1470091): n equals a, t, c, or g
  misc_feature (1569020)..(1569020): n equals a, t, c, or g
  misc_feature (1602912)..(1602912): n equals a, t, c, or g
  misc_feature (1603734)..(1603734): n equals a, t, c, or g
  misc_feature (1637998)..(1637998): n equals a, t, c, or g
  misc_feature (1664854)..(1664855): n equals a, t, c, or g
ggattattatgctactggttttaaaataattgacttatctaaactaaaaggaggaattaagagagagtttaacgcatctaatagagaattatataaaaaggatttgattatttatgaaaaggatttaaaataaataaattcgcttatcttctcttcaatttttattactcataaaaattaatttatgtatttatttatatattaatgttaaataaagtaagtagggggaaatatgtcaaagtctgggaataaaaaccaaaattgcccaaaatgtaataacagcccatggatacaaagagcaaataattttattgctcaaaatcaaaatgttcaaacaggtactaaggaatattatcaagttgaagcagtaaagtacttattaaataatggacattgtgggatagattgtagggcaaaaattagcgatattataaagggaataaattatcccaaaaatagggaagctttccaacatgaagtgttgataccactaaaacagtatggcatcatagcaacattggtttatccaggacgtaaaggaggcgtatttatcccatgtaataatgatgaaataaaaaaagtggcaaaacaagtgtttaagaggatagaaagtgaattagaaaatttagaaggttctgcgacaggagttcaaaatataaaaaatttagcaaattctctaaaaacgactgttcacaatcttaagaacactatttaaataaatgcatcaagagtaattatgtttttgttttttacattatcaaattttccatctgtttttaaaagttctttttttatcctctcctctgcaactctgcaatagtattcatcaatctcaaagccaatataatcaatccctaacctaatacatgctattgctgtgcttccaattcccataaatgggtctaaaacaagatttgtctttttaacaccatgcaatttaatacacatctccggaagttttggaggaaatgttgcaggatgaggtctttctttttcttttgattggattgtttcataagggataaaccacgtatttcccctatctcttaaatctccttttctgttaaatctctttatattgcttttatcctgataaggaacaccaattgctaatttgtctaacttaacgttcccattttttgtgaagtggaaaatatattcatgcattatacttaaaaatctatcactgtttattggcttgtaatgtccaacagcaatatctccaataatatttgggtaatttccaacatcttctttttgtattgcaattgattttacccaatgtatagtattttgtaatttaaaatgttttcttataacattagcaacatcaaaggcaatccacgggtcttttgcagtatagccaacatttataaaaaatgagccgtcatcttttaatactctctttatttctttgacaacttcttcaatccaatttaaataatcttctctacttaaattatcagagtatttgttgtattttatgccaatattatagggtggagacgtaacaacaacatcaactgtcttatcttttaactgtttcattccctctaaacaatccatacagtagattttatttatctccatttttaatccccatcattatttattctatcatcaattctgcaagcttctctacttctttaattcccctatcaaaatcatttaagtttaaatattcttctttagaatgggcaagctctaatttgccaacaccataaataatagtatctgcctttaaaaatttgttgaagtaatatgcttcgcaagtagcattaaaaaatgatattttaaagtgcttagacaacttatttattaactctttattttcaagcatgtagaaattagcataatgtctttcaggatttaatgagctttttatatgctttgaataatttttttgagataaaaagtcgtctatcttttttattatatctttttcaacacttctaacatcaaataagacataagcataatctggaatgatattgctttgaattcctccttttattatggttggagttattgaagaactgtagattttatcaaccttaatcttttccaaaggaagattttttaaatctaaaataactctgcttaagatttctattggatttaggccttgagatgaggcatgcctcgcctccccaaaactttcaacaatatactcaaatcttcctttatgtccaatacaaacatttaagtcagtaggctctccaactatgcatttaatacctctttgaattttatttttatttcttaaatattggcaaaaattgtaaataccatttgattctgtttcttcatcaggagatataactaatagagagttattgctatttaaaaaagcatgaatcattaaaaccacattccctttagcatctataactccagtcccataaaaattgttatcatcttttttaaaatttgattgaatctttacagtgtctatatgtgaatttaatatcaaatcaaagttttctttttctttatatgctacaaagcatccttcaatgatagtattttttattcctaagttattgaaaagattagataaatatttaaatgcctttttaacaccaattctattatccgtcctaattttcaccaaatcctctaagatttttaaataatccataattatcatctcataaattctactttttctccaataatttcatttaaatcaatatcactacacttaaattcaagcattgctgttgagtaatttttacatttgtaggttttccatggctttaatcttacagcttcgacaaccctatttttatcaataaaaattatatcaataggataaagcataaagaatgtatgcatagctatctttcttcttttgtataggaaaagcatagctttatctccaatatctctaagcattaaaccaaaagctcttttaataaaattatctgccaatacaacttcaaattctaaatttccaactttaacttttttaattttcttattttgcatttttttcactttcttttttgctgtatgggacagggatgtaataaactgaaggtttggctcccattggttgtggataaagctctaataactcataaacctttcttggaacatttgtattaacttcaatacctaattcttttaatttactaactgttaaagggtaatcatgtgtccatgttcctgaagttagtttttttgcgatttctttagctttttcatctccatatttatctttcaacaactcataaacaaattcttccatctgtttaatagcttttttagatatatcaaccaatattaatgtctcatcacttactttttctcccttcctatagtatgcctctaagatagatgcagcaggatactgcccaatctgtggatctactggccccattacagcgtttttatccataattatttcatctgcagctaaggcaattaaacttcctccactcatcgcataatgtggaattataactgttgtttttgccttatgttcctttaaagctaaggctatctgctcactcgctaaagctaaacctccaggagtatgaatgattaaatcaataggcatatcttctggtgttaatctaatagccctcaaaatctcttcactatcttcaatagtgataaatttatatattggtatccctaagaatgttaatgcttcttgtctatgtatcatagctataactcttgttcccctctgtctttcaatctcccttatacatctcaaccttttcattatcctatatctcatcatcatctctggataaataaataatagaaatatgaataagaagaaaaacatatccatcgatgtcatttcatcccccattatttttgtaaggtaaattattaatatcacttcatgaatataaatatagttgccttattaataggactttcgcaggaaaaatatttttattgaatattgacactctttgagtgtctaagctccaaatttatacataaactgcgaaagtcctatttatcatcacttaaactggtgattgactatgagtaaaattggatttaatccaataaaaataaaatctttttcaaagattaaaacttacgatgatacattaccatcattaaagtacgttgtattagagcctgcgggattcccaatcagggttagtagcgagaacgttaaagtttctactgatgatcctatattattcaacatctatgcgagagaccagtggattggcgagattgttaaagagggagattacttatttgataactcaatccttccagattatgctttcaaggttatttcaacttatccaaaagagggaggaatgattacaagcgagactgtctttaaattacaaactcctaaaaaagttcttagaacacagtttaaaaaagctaagttcagcgagattattgggcaggaagaggcaaagaagaagtgtagaattattatgaagtatttagagaatccaaagctctttggagaatgggctccaaagaatgtgttgttctatggtcctccaggaactggaaagacattgatggcaagagctttagctacagagacaaactcctcatttatattggtgaaagctccagagcttattggagagcatgttggagatgcttctaaaatgattagggagttgtatcaaagagcatctgagagtgctccatgtatagtgtttattgatgaattggacgctataggattaagtagggaatatcaatcattgagaggagatgtttctgaagtagttaatgcactattaactgaattagatggaattaaagaaaatgagggagttgtaactatagcagcgacaaacaacccagcgatgttagacccagcaattagaagtaggtttgaggaagagattgagtttaagttaccaaatgatgaggagagattgaagattatggagctttatgctaaaaaaatgccacttccagttaaagctaacttgaaggagtttgtagagaaaacaaaaggatttagcggtagagatatcaaagagaaattcctaaagccagcgttacatagagcaatattggaagacagggattacgttagcaaggaagatttagaatgggcgttgaagaaaatattaggcaatagaagagaagctccacaacacctctatctctaatcctcataatcaaagtaattatcataatactctattaaataatctccaacaatccataattcttttttatgctttctatataaatttataagcttttttattgcttctttattttctcttctaaatatttcgtctaatattatggttaatgcctcaataatatcagaattattaaaatccaaatctgcccttatcatctcatcaataacctttatcaactcctcatcatcagcatttttaacaaactgatttcttaaaaatgatttaaatgtataaatattttttctctctaatggaattagttttattaagccaatggctttatttaataaactgtctgtatttaaaaactcatcccatagataatatttaacaaccaaattttttaaaatttttaaaatctcttctttaggtttatcttctatttctttaaatatttcttctgcatccacatagttgttgttttcataagcttcaattaaagcataggcatgtttgcagttgtatttgtattggcaggtgcataatccaaaatagttattatctaaatcaactttaactttataagtatctgagccaacaacctccccaaataaaaaatttttgtattttatgcagtatttgactaaattgtttctataatatagctttcctctttctattatttttgggtcgtagttcatggttatcacaaaaattatttaaattttttataaatcatttcaaaaaatatcggcagaatataaaaaactacagtaaatccagcaataaagccagttataaacctcaactcattaaaactttctctcaatccaattagttgagtggttccatcaactgccataggaattaatgcaattattaaataccatttattagggattttaaaatcatctaatttcttaataaatggataaataatcatccctactaaaacccctgtataaatcccaaaacatcttgcacacacggccattttatgtccaaagataaaaaagcttctttgtggcatttgatggcatataagggaataaacagcgtataaacatattgaaataaacttccaaaaatttgatgtttctcccaaatatgcaaaataaggtgctaaaaaaatactcaaataaaaaataagaaaagaaataaggactattaaataatattttttcataaccccacttatctattctttataacaacatatataactccaccaacagccccgagtattgctccaaagatgattgctgtaataaatccaataatgaatgaggccccagtaaacatcgccgcttttaatccaagcgctgataggtatgcagacataaataaaaagcttagaattgaagcgataactccccctataactccggatattgctccaactaatccacagttttcataatcgcaaatacctccagcattaacatagagatgagcggcaacagcaccaccaataacataacacaaacaacaaatagcccccaatataccgtttataattcctccaattaccgctggttttaacattctttcctggtcaaaacttaccatatatttcaccgagtttatttttaattataattacattaaaatttttattttttgattttatatatttttctatttttatattattaacatttacatccataagcttcatacaaagttccattaatcactgtatagattggaaatcccttaacttcccatccgtcaaatggactaaattttgcctttgatttaaacagttcagcattgatttttccttctttttttaaatcaataattgttagatttgctaaattgccttcttcaattttgttgtttatgttaaatatcttagcaggattttttgataaaacccttatagcatcaaacaaacttattaatcctttattaactaaatttaaggttaaaggaactatcgtctcaattcctggaatccccgaagggcagtttttgacatttttaagtttatcctctaataaatgtggggcgtggtcagaggcaataatatcaacatctttattaacaattcctttaattaaagcgatattatcatctttttctcttaatggagggttaaacttgccaaaaccctttaactcttcagccatgtctttatttaaataaatatgatggggagtaacttcaacagttatttttatattttttaactcttgtcttactttttttattaaatatagagcttctttagttgaaatatggcaaaaatggacatgtggttttttattactctgcctatcaataatctttaagttttttataacttctttaactgcttcaacttctgatttttcatccctaattttacaatggtctatccagctgtttaattgatatttctttagattttcatttattacatctttgtgttcagcatggatgcagaaaagcttattttgatttaaaatatcttttaattttgaataatcctctataaacaaatctccaacagatttaaccataaatatcttgtatgcttttgcatcttctacagttccaaggtaattattttcagtaactccaaaattcaaaaacacatttatcttactatcctttttacaatcttcaagttttttataaaatagttcttttgtagttattggaggtttattattaggcatgtctatggcaaagcaaactcctccatttattccagctaagctaccacttaaaaaatcttccttcttttcctctccccatctaaaatgaacatgtgcatcaataactcccggaataactaaggagttttttatatctattatttcatcatctactttaatatctttggctatctttttgattctaccattttcatcaattaaaatatctccttcaatgattttgttgtcttttattattctacagttttttaatagcatggtatcacatcttaatttattaatacaaaactaataaaaataaaaagtattaaataaaaatattaaccatctttaagagtttagaggctggtagttatgcaattgggaaatgcagaagtattttatatagctatgggaatttatctatttttattatttgctattgcatttatgacttatagatgggttaataaagaagtaaaaccagctaaaacataacttcaaactttttttaattagcttacctcctaaaatccaaaatataactatgctaatggcaaatataaagcataatctaatagtaatggcttttttatacacaaataagttaaatgtgcttagtaatagaccataatagctatgttcaactaacacattaaatatttttccaactacatagttacgaaatgctattctatcctttattgttatttgcctatgcatttcaaaaccataacccaatatgaattgaaaagcaaacaacaaacctaatccaacaataaccataaatataatgcatggaatagtaggatactgcagaggctgaaacattataccaatagctataagcaaataagttattaagttattaaagttagctttattattgatactgcattatctatgtaatatattattttatcgttcatgagcatcacaattggttttttgactagaattaaatttataacaatctatacctccctggttttggttcatctatatctccatatttaattaattttttaataatattttccaactcatcctctttaatacctttcttttttgcttcttcagctatatcttcatgttcaacaagttctgatttttcagataactccttaattatctcatagacggttgttaatttgtctctctctttcttagacacccctaaaattttatcaacatcaaatattccagtctctgggtcataggcaatttcttttaagcattcagttattatatttattgcctcctttgcatcttcctcatcaacaacatcctttaactttgcctttgcatgagcttcagcaatccttatagcagcctctaactgccttgcagttatctgatgtttttttctcatctctacataataattaacaaataattccttagccttttcactaattatcggctttttctgtcttgcgtagtagatatattttattataaattccttgtctattttaactccatcaacctcaaggtaatctaaacccatctccctgtttattttctcatctaaatatgctctatgcaaatctacaatgtattcagcgatatctttatccttatccttatcagaaacatctctaattggaaatattaggtcaaatctactcaataatggggctggaatatttatctgctcagctacagaaacctctgggttgaatcttccccatcttggattgcaagcggctaaaattgcacattcagctggaagttttgcatttattcctcctttactaatatggattgtctgactctccatagcctccaaaacatagctctgcagttctttattaacagttagctcatctatacatgcagttcctttgtgggctttaactaacaaacctggcttaataacccatgtatcttcaccaatctctgtcttctccctaacaacagcggcagttagcccaacaccagtggcggtagtaacagaaccgtataaatttcctgggatttcagcaatctttcttagtatgactgtttttccaattcctgggtctgtgattaataatatatgaatatcagccctctttccaggttttttaactccctttatctgttgtagtaagacagccttctttattgcagaatgccccttaatctctggaattaatctatctgcaagtatattaacaacatcttttcttttagctatttttttaatattttcaatatctgaatttgttaatttaatttttacttccccatccaaaacctcacagtgtagggctttaacatgtatgtcatagattggtagctttttactcttcttaacttttattgggatgccagttatcttcacccttccagcatatattccaggactgttttctaagaacacagttatgtattttggcggctcttcaggattttccattaaatccaatggctgttgaactttaatctcttggaagtcagtatatattgatttatgctcaattaggtttaactcagctccacattcacaaacagctttttcagagtcagtgtttaagatatctatttctctaacaacttctcttccacattttggacatatataataagcttttttaagcattggtcttatttttgatgccataacaatgattccttcaaattcaactaattttcctaaagttttgctcctaatatcctctattgtgaaaattttcccttttcttgtagttttaaaaatttttgggagattttttacagcaattattacgtttgttggatattcatttcttaaggtgtaataagcatcgttgtagcactcttttataaaatcaatccctttttgtggattatttattaaaaattctacaaattccattaatccgtaattgtagagttgatttaaatcaactacaactctttcattgtctaagataatatcttcctgatgaatatttcttaaataggcagttaaataatccctaacttcctctaaaattaagtcttcatctctcaattccatatctacatccccatacgaagaaatcaaattttagagaaattttaaaacgaaaaatagttgaaattttgcttttaatcttaattatattatttagtagttgttctatttatctattctgtcatttattataaactatttatataattaacaacctttaaaactcccatggctattccttcaacctcaattccaccccttcctttagctccatctccaactaaataaaatctatcattaacaatattgtcaatatcagttccattagatgcatgatttacaggccaatcatccctatatgactgaatatgcaatattttgtagtcttttcctttaaagaggttttcaatatcctctaatcccaaatcaatttccttttttacattgttggttagctgtgtttgatgagtcataactaaatgccatccttcaggagctaaggatttatctacattagttacttggtttaagccgtttatcctctcacattctggggtaaagagaacaccaccatgttttataattccttcttttgtggctatgcttatctttattcctttagatggctttggctttgatttcaaaaattttatattgcatattttctgggtttcaattggagagatgttgcttataacaacatcgaattcatagtcatcaatataagctttttcatcaatctcaatccttttaacttcatattccttaataatttttccattgttctttttaataatcctcgaaagttcatcagtaactgccttacatccacctattggtattccaggtcctccaaatttgtggtagtttttagctatctctataatttcactcataggtgtttcataagctgttaaactcaaagcccatccagtaaatgcatttccaacctttaaagctaaatcaatctcttctaaaaactctccaaatgagatatttttatcaacttttcccaactttaattttgtagctaatttaaatgcttttgccttttctttaaaacctaagagtgaaaacagctctttatataaatactccttcccattaattaaaaatgttccatctggttttgagtttattatttttacattagctccagcctttcttaaagcttgggctaaatagccatcatttccgtgtggtatcatgtgtaaagctcctgttgttagttgaaagccctcatacttcaagtttgtaaatctccctcctaagaatggaagtttttcaaatacaacaacttcatgattcttagataacaatgctccagctaataatccacctaatccggctccaacaataccaattctcataatatctcccttatttgtttataatttcccagtttttaaatattttgatatcttttgagcaattatttcctgattatgccatgttccgtgaaatatacccttaggaatctcatacctcatagctcttattatctttttatcaactttcccaggatttgccttagcaaagggtgtttgtggtaaaggcataaaagtatgagcatgtattttagcacccatttttattaaatccttcataacctttattgtcttttctacatcttcctcagtttctccaggcaaaccaaaaataaaatctacatctactccaagtccagcttttctcgctactcttacagcgttatagacatcttcaaccgtatgtcccctatggcatagttctaatactttttcactaccagattgagcaccaataactaaattcttattatcagcatatcttaaaattaaatctaccgtctcaatattcacatgctctggtctaacttcagagggaaatgttccaaaaaatatccttccattattacctaaaatttctctaatactttctaatagtttttcaattttatcaatatttaatgtttttccgtctttagaaccatagccaaaggcatttggagttataaaccttatatctttcaaattcctttcagccattatttcaacatatttatatatattttcaacatccctatgccttatcttttttccaaagattcttggtgtttgacagaaatagcatttgtaaggacaacctctcgttatctctatatgtccaaatttattatgctttacaggaaatggtggatacttatttaaatcaacaggttttcttcttccagtgtaaataaattcattatcatttaaataggcaatacctttaacttttttataatcctcatcttcattaaccgcctttataaattctggaaacgtctcttctccctctccaatgcaaacaacatcaaatcccaattttaacgttccttttgggtcacctgttggatgaggtcctccagctaaataaataattttattcctataactttgatatttagcttttaattcattaattaattcataagttttccagagttcagttgtaaagaaagatatggcaataacaaccttgtcatatttttttaaaacttcctttaaattaaaaatatcttttttattggcaaaatatattgggaggttatcaaaatattcatcaatctctaaagctccaatcaatgcattgaaactgtttttatgtagttttgtataataaactaccaaagcggtgttttcttccatattgctccctaaacaatatttatctcaaatgagataattaacaaaaaactatattaatgattcctttaaaagctaaagtatagaataaaattttaatgctaaaaattttttggtgaaatttatggcaattgggacacctcttttgaaaggaagtataaaatttttgttgttaggaagtggagagttagggaaagaagttgttattgaagctcagagattgggaattgagtgtatagctgttgataggtatcaaaacgccccagctatgcaggttgctcacaagagctatgttattgatatgaaagattacgatgcattgatggcaattattgagagggaagagccagattatattgttcctgaaattgaagcaataaatacagatgcattaatagatgctgaaaaaatgggttatactgttattcctacagctgaagctacaaagataactatgaatagggagttaataagaagattggcagctgaaaaattaggattaaaaactgctaagtatgaatttgcagattctttagaagagttgagagatgccgtagaaaaacttggcttgccttgtgtagttaagccaattatgtcttcatctggaaaggggcagagtgtagttagaagtgaagaggatatagagaaagcttggaagatagctaaagaaggagcaagaggaataggaaatagggttattgttgaagaatttataaactttgattatgagataaccttattaaccgcaagaactgctgaaggaactaagttttgtgagccaataggtcatgtccaaatagatggagattatcatgaaagctggcaacctcataatatgtctgctgaattaaaagaacaagctcaagatatagctaagaaggttaccgatgctttaggtggttatggaatctttggtgttgagttgtttgttaaaggggatgaggttatatttagtgaagtttcaccaagacctcatgatacaggaatggttacaatgataactcaagaaatgagtgagtttgaaattcatgttagggctattttaggtttgccagtatcaacaaaacttattcacccaggggcaagccatgtaataaaggcagagataaataaatatgctccaaagtatcatatagaggatgctttaaaagttccaaatactaagttgagattgtttggaaagccaaatgcaaaggttggtagaagaatgggagttgctttagcttatgccgattctgtagagaaggcaagggaattggctgaaaaatgtgctcatgcagttagaattgaatgattggatatttagataatatttgtcttgttgaaaaaatttaaatctatgtttaattagcttataaaatctatttcttcatttgagaattttttatttaatttctaagggtttgctggtttgattatttagaatatttgagtttattaaattatttagatttttaaaaattgagattaattaggtaagtaaataagatttctctaactaataagttaaatttttgaatttaaggagataaaaatgcttagttttagtaaagagataaaattttaaatactaaaaggtttatattgtaagatggttatttatccttagaaaaatatggtatagaaaagcttaaatattaagagtgatgaaatatattatgttgtgaatgattgccctgttaaaatcagacctcttggaggatggaaatttaaatgcttttactaaatattttgttaaataattcgtgttaaaatcagacctcttggaggatggaaatacaagtatattataagtgtattggtagtatataaatttttgttaaaatcagacctcttggaggatggaaatctgttttatcaatttttcagcttcatctggtgttattatgaataatgttaaaatcagacctcttggaggatggaaatctgcccgctcttacctttcacggcaatataagcattaaacggttaaaatcagacctcttggaggatggaaacgttaaacaatctgctatgataatcataactaaattcatttgttaaaatcagacctcttggaggatggaaacgaagtatcttcatttactattactaattgataaccttgtgcatctttagttaaaatcagacctcttggaggatggaaacttatctcctccatttttatctgtaaaaattttattaaaattaaaataattaaaataagaccgtttcggaatggaaatataatttaactaaaaacttgtatgcaactgcaacgtcatttattattaaaataagaccgtttcggaatggagattagcagttttgtcagctattcatatataaaataaaaatcttttgaagatttagacttaaacatttagtttatttttttaaaagtctcagagttttaaaatacaaagtagcaaataaaacaagcactgggataatttccaatctaccaatccacattgctataattccagctatttttccaattactggagtttttaaagtaactacccctaaagatatgcctatatttgaggtaaaagaaacagcatcaaatattgaatcgtaagggttataacctaaagctataaatattaaagctgttaagaacgaagataaacagtataaaaagaatacaacaaatgcttccctaattattctataatttaagtccatatcatcaagatgttcatgaatcactgctgattttggataaataatttcttttatttcatataaaagtgccttcagtataactaaaaatctaattatcttaacccctccagttgttgtccctgcccctccaccaattagcattaaaaaaattatcaaaaatagggataaggatgagagattacctacatttatagttgtgaatccagttgatgtcattgctgaaactactgtaaagagagaatctattattggaactttatcctttattgagatgataattgaaataaaggcagtaacaattaatgcatactttgtttgaatgtcattaaaatacttgcccgttagtaatttgtgatgtattgaaaatgacataactcctccaaccatcattatgccaatcataacaatttttgcaaaatcgttgtatggaaagctataattgcttatactcattcctccagtagatattccagtcatggttaaatttaaagcatcccaaaaacttaatccagataaatataacaaaagaacccctaaaatagtgtataaaatataaatccagataatagtttttattgttcctatagcacttggcattatcctctcttgtctcgcctcagatgtatataaaagataagcaacagttccagaccttgctaagacaagagctgataaaaccaatattccaactccaccaatccactgctgaaaactcctccaaaataaaatagattttggtaaaacctcaacattaggaataagagtcattccagttgttgtccaggcagacatgctttcataaactgcatcaacataagaaaaataatctatagataaatataaaggaatggcccctataaatgaagctataagccaagccaatgcagaggcaaccatggtatgatgtagttttaaattttttggtttagtagctctctttaaaacaaatccaaaaatagaaaaaaataaacctggaattaaaaaatttaaaaaggtgttttcattgtaataaactgacactatacatggaactaatgtaaatattccaataatttgtataatcccccctaaaatatgtaaaattccttcaatgtctttttttgttaatctacagattcccataattctctaacccatagaaacatttacctcgaaaagtttaatatcttttgtatgctccttaattaaaacaacatccttatcatacatttctaccgaatagtttattatctcagacatattataatatttaagctttggatttttatcaatgtaagatttgtttccatattctttgagcattttgttataaaacttatctgctaaactttcatttttaaatatccaaaaattggttataattacttcatttttaccaaaatattttttgcactctcctttaaaatatatgctgttgttattaatataatcaacacgtgaaattccccctattctaaaaaatccgttgctattggactcataataactctttgtattctccttaagtattttataaaccttatctctcaaggttttattggaaaataaggatgcattatattttattgtaaatatctccatctaatcccagaaatatcattcgctttaattattaagttatttccaacaataatatatctgtcagagagtgctttttcatttttgtaataataaacgcccctacaactttcaacagagtagccattttctataagttcttttaagatttctgtttcattgaaatctcctttttctattactactgcatcactacctattataacagtttctatattgttgatgttccgttcccaatcaaatccgtctttttcataatagaatctatcacaaacttctggaacaaaagttaatatattttcatctccaaagtcatttattgtgcttttgtttatctctacctttttaaaactaaaatttgatgagctaaagtagattccaaaaattataattaaagaaatcaaaaaaacaataaccgaaagagttttgtccatattaatcaactccagcctataatccctcttctaacatatcttcctcactcagcccttctaactcaatcatcgttttcaatctttcggtaattatattcaaacatttatcaacagtctcactaatctttatattctcaaccactggaattcccttcttttttgcagtttcaaccatgtaatcgtttatcattctaatgattttaaagtattttaaatacctctcagtaggtctgcttgaaactcttccccttgcgtagaatctcattttatgcaactcttcattgtagattgttagcataataaaaactacatgggaattttctaaatatttatcttttaaaagtgttgggactaagtgagttccttcgataattacactctgcccctcaactaagcatctatctataactccttccactccagttaatactgcctcagaatgcctctcaaaccctttaatgtatttattgccctcatcatctctcaaaaccttccaagctgtataacttgattcgtaaagtgtagggattaaatctcttgatataacctttctcataacttcccttatagaatcagttccaataacgcttggaatacccaatcttgaagctatctcaaaggcaatagttgaagttccaacaccactcgctccaccaattaagataactatcggtcttcttcctaaaaccattctccatagtagatattttttagcaacttcatcgtaattttttgaaattaagtaataataaactctcctcctcaaatcagccttatctataactctgatattttccttttttaacatctcgtatatatcccaggctattctataggcaatacttggttttaatccagcggctgttaaagaccttgccaaaataccctttgaaaatggcatctcataggattttcccctcacaataatatcattctgcaaatccattattccaccgaaatttaatctaaaatttcatcagcatccaatttttcagcattataaagatttttagccctcaaatagagaagttcatctttatcatcctcaaccacaacaaaaattttttctggtttgtatttttctataaatctctcaacattctttcgtgctatctcaacctttttctttaatccttctaatgctttttctggaacgcctatagctctcatatcttcaatatctaacattccctcagtgcatacaacttttaaattaggatttttgtttttaagctttttaaataactttttatttgagacaatgtataatgcaccttcatctatttctttttcttcaaattcaaacccaaagttagctaagattttatttaaatgttcttggcattttataatcaatttacagaactctttagcttcctcttcattcaactcatgctttggggcttttttatataagaagtcatctgcctcaatcaacaaataaatagcttttttaaattcattgacatctatcttccctggctttgcatctttgtaggatatttttttatcatccttttctactcttattttagctttttttagttgggaaatagttgaaattccctttcttatcaaatcctttgaatattcaactctcatcttctcctcctctattcttctctcttttcagatttttccttttctttctctaatttttccaactcctcaacaagcattggtaaaaagacaccaacatcagtaactatccccaaagcttgtgatgtccctctatccattaactttgttacaaccgctggatttatatcaacgcagatggttttaacccatgaaggtaataaattacctgtagctattgagtgtagcatagtagaaagcattagaaccatatcctttccttttaaaagctctctcattttttcctgagctttaacaacatctgtaataacatctggtaatgggccatcatccctgatacttccagctaaaacataaggaatgttgttttttatacactcatacataactccttcctttaaaattccctgctctacagcatcttttatgcttccagccctcattattgtatttatagcccttaaatgatgactatgccctcctggaacgctctttccagtctttaaatcaactcctaaagatgtcccatataaaacgctctctatgtcatgagtagctaaggcatttccagcaaatagtgcttgaacataccccatcctaataagcttagctaaagcccatccagctccagtgtgaattatagccggacctccaacaactacaattcctcctttacctgtctttctatatttttctctaatctcatacatctccttagctattcttctaataattgtttctttaggcttttctgaggaggcatctgatttcataaactcaaataacccccctccttctcttggtttttctggagggatgactctaacccctttatgcccaacaacaactaaatctccttttttgatatttcttattgtctttacttcagccctcatttcatctggataaacaacgatagctccgtccattttttggttttcaacctctatccatttgcctttgaacctaataaatgttttatgattggttgttgaataaaagccctctggtaagaccatatccttctcagctggctgtaactcaacctcttcaatctctggaatctcagctcctaaatccctcaactcattcaatatttcatctacatgcctttcatctctaccaataaccaatatctttgcataacttgggtctgtttttctcttcccaatctcaaactctaaaactttataatctccgcccatatctaagattttatcaaaaaccttaggcaggattaagctgtcaataatatgccctctcaattcaatttctctcatgaacataaaaatcccccaataaatgttatcttaggattaattaacgatgatgaagtatttaacaattgtcatcaaaacctttatatactattttgacagtttttaatccaatttttatctactttacaaagagggataatttgcatacattaagatttaaaaaagatagagcgataaaaataagtgaagagctatttcctgatgagttatgtgagagatgtggaagatgttgcattttacacgcttacaaaactgaagatggaattaaaacaatatattgtgagcatttagacccagaaacaaaattatgtaaagtttataaagataggtttaaacatagatgcttaactgtaatggaaggaatcttagctggtgtttttccaaaagactgcccctatgttaaaaatttaaaaaattatgaagagccatggttttataggcatttgagagattaggtctttaaaaattcatctattttttcagctaatgtgtcaaatatccattcaaacttttcgtcatctctctctaacaatgtaactctaaatccgttaagttgagagcagaatgaggttagaggaactacacagattccagtagatgctaagagataataaacaaatttcttatctatagatgcatcttttatttggtgttctataaattccttcaatttctcattctctatttttattgaattgtttccatttaaatagttatcttcaaatacaacagacatatagaaagctccattggctttatttgctataacaccatctaaatcttttagttttttgtaggctgtgtttgaccttttttcaaagaacctattcctctcctctaagtattttttgtaatttctatgccccataattcttggaatagccatttgtggcaatgtagtggagcaaacctctatcaatttggctttataaatactctcaacgtattttttaaattcttcatccttatcggcattgtaaatttcaatccatccacatcttgcccctggccatggaagttcttttgatataccctttaaagataaaccgcagacatcatctataacctcacatagtaaatgctgttttttcccattatatactaagttacagtatatttcatcacaaataataaataaatcatattcattggctaaatcaacaatctcatttaagattttttttggatatactgctccagttgggttgtcaggatttataaccaaaattccactaactgctgggttgtatttaatcctcttctccaaatcatcaatgtctggataccagtagttgtaagggtctaagaagtaagttactggaggagagccagcatgggatgcctctgcagaagaatgggttgagtatgatggggatgggtttataactctaacctgcctcttcaataaaccataaatctttgcaatggcatctcctaagccgttaaagaatatgatgtcttcagcagttatctgaactcctcctcttttatttacttgttcggctaaaaattctcgtgtttctaataaacctttagtaggacagtaggcataagaacagtcgtttttaacaatctctgctataatatctttaatccaatctggaattttttcccctttagccactgggtctcctatgttttcccatgttatgtttattccaaactcttctatttttttagctacatctacaatctccctaatttcataactcaattctttagcccctacatctattataggattcctcatgttttcatctcaaaatggaactctattttgtatgacacttttgtgtaatttaccattatcccagtagtatataaactttactcttaaaatagagttctatttttttatatgtttgaagtgttatatatcgaatacttatagtgcgttacaaaaaacttactatagaaaaggcacttataaaaccaaagacttttatattcttaccttaaaaattgcagttaattttgaaaagcacgataaacgataattccctaaatatatggtgaaaacaatgaaatgcaaattttgtgataaaaagagttatataaagctcaaatcaccaaagatgtatctatgcaaagagcattttgttgaatattttgaaaataaggttaaaaaatcaatagataagtataaaatgctaagtaaagatgaaaaaatcttagttgctgtttctggaggtaaggatgggcatgcagctgcatgggttttgaaaaaactcggctataatattgagttattccacataaatttagggattgagggattttctgaagaatctttaaaggctgtaaaggagttggctgaaaaattggaagttcctttgcatgttgttaatttaaaagacattactggaaagacaatggaggatattagaggtaagaaatgctctatatgtggaacaactaaaagatatttaatgaacaagtttggttatgaaaatggatttgatgtcatcgttactgggcataatttggatgatgaagtttcctttattttaaacaacttattcaattggaatattagatatttagctaagcatgagccagttcttccagctcatgataaatttttaaagaaggttaagatattctttgaaattgaggaagagttaattttaaagtatgctgaagctgaagaaatcccatatacaaccgttgaatgcaaatatgctgagagagctataaccttaaagcatagagcttatttaaatgagttagaaaaggaaaggccaggtataaagtatcaattcctatctggctatatgaaaaataggcatctgtttaaagttgaggaagaggatttccaatttagagagtgtgaggtttgtggaatgacatctgctggaaaaatctgctcattctgtagagtttggaagctctataagaaaaagaaagaaaatagaaattaatttatcaattttagccaccatgtatttagttcgtctaattctctatcggatttagcaacataggggacataccctttatctaagcttttattaataaaatcttcaactctcttcaaattttcatttgtttttgttccatcatcaacataatcaaccactaaaacaaactttccagaatcttttactttatccaacaattttattctttcatttatctcttcctctgtcttttgctctacaccatcataaaacaaatcttcaacagcccatccagaaactgtatttaataactttccatgtttatcgtactccaataatctttcaccattttgtggaattattataaagctgttgttagttttgtttctgcagtagtttgatatctcaacaataaatttaatcatctcctttgctgtaaaatcttcatcatagccattttctgcccagtattcgaactcatcaaccttatctaaataaactccacagaatccttgctgaataattttatctaaatagctaaaaattattttcttccattctggatgccaatatttcacagcataacagccctcccattctgggttttcatctcctaaccactttggaggattttttagccattcattgtcccaatagaacctataatcttcagcctctccaatgctgatataggcaataggtatttttccagcttttttaagcttttctatctcttcttcactatattttccattttcagtcccatcttttgaataatctataacaattaaagtaaagtttgagtttgctatttcatcaatatctgcattttgaagttgatatgcccataaaaattttaaattgttagaatttttgctgatatttgtaaggttttccgcatttctaatattatttttagatttagacatcattttagggttatctaaaaaagtactatcaaatgaaataaaaaatcctacaattaaaataatgcaaattattattcctaaaatatggcttttcttcatgttctttcccctaattttatttaaatgcactcattaacgtccatgcctcctttccacttataaaagccctattaaccaatctcttaaagattattttgcagagttcttttttatgctctgggattttttcattcttgtcaataaactcattaaatttccttatcaatagctctttgtcctcttttgatgcctctctcatatttatatctaaaaatttatttctaactttttttgtataaatctcatataaaataactgcaacagcatgagataggttcataattggatacttttcagatgttggtattgaaactaacaaatcacatttatctatctcttcatttctcaatccatcatcttccctaccaaagacaatcccaatgtttcccttaacctctaagattttatctgccaactcttttggtgttattggaactctctttaaatttctatctcctcctcttgctcctgaagtggcaataacaaaatctaaatcccctatagcttcatcaaaggtgttgtagaatttggcattgtctaaaatctctcttgcatggactgccatcatataggcttcattatttattatgcttttatctccaactattctaagctcttcaaatccaaaattcatcataacccttgctatactaccaacatttccactgtattttggattaactaagatgacagaaatcattattatcactgtttttccttctttttcagcttataataatggtactcaacggtttttatattaatcccagtaatttcagctatttctttaggttttttatctaaatactttttaataatcttatctacattcgtaggtcttccagtctttgcctttattggaataacttcgacatcaactccttccaaagcctttataatcttttttgagcttcttttatattttgattttggtaaatatatcttctttggctcacaactttccaataaagcaatagctacatccctatctaactctaagtttatataaatctcttcttcattttcacattctttaattttttcaatcaattcttcctttgtttttgctattaattttttcataatacaatcacttacttattttttcttccttttcttctttaacctcgatttaaccatctttctctccatagggcttcgccctattggtatacccgggatgcactgcctcgtttcactcggcagtgcctcttataagttattttttcttccttttcttctttaatctcgatttaaccatcttcctctttaaagggctaccacaaatctcacatatatcttcttcataatctactggataaagttttttacaaccttcacaaatctttctccaaataaaatctttatttgttggttcaaaagctattcccctaacttcaatatttaattttttagctacattttgaatgccataatcgtcagtatataatatggcgtttaaatttagagctaaagctaagacaccaatatcttgttgagacaaattatctccagtttttttaacaacttcttcaaccttttttatatactccctattaggactcattatttttaattttccaaaatctaatgcttgttcaacaataattttttttgattctatctcttccaaaacttctggggttgtgtaatgttccccctcctctataattgggttgtatccatgaataatagctgaagcatccaacaccttaaccttcatgattccactcctataaatgttaaataactgataaggagatttattaataatccataatttataaaattctggtggtggcaatgataacaactgtagttggtagttatccagtagttaaaaaggaagaaacattcttagataaggtaaaaaaggtatttggcttgtatgatgaatataaatatgccatagagagggctgttaaagaccaggttaaagctggagttaatattataagtgatggacaggttagaggagatatggttgagattttcacaaacaacatgtatggctttgatgggaagagagttgttggtagagtggagtttataaaaccaataacactaaaagatattttatacgctaaaagtatagccaaaaaactcaatcctaatgttgaaattaaaggaattattacagggccttgcactatagcttcatctgttagagttgagagttgttattcagacaatagagatgagaatctaatttatgatattgctaaagcccttagaaaggaagttgaagcattaaaaaagcatgtcccaataatacagattgatgagccgatactatcaactggtatgtatgattttgatgttgcaaggaaggctattgatataatagttgatggattaaatattaaatttgccatgcatgtttgtgggaatgtttataatattattgatgagttaaataagtttaatgtggatattttagaccatgaatttgcttcaaataaaaaaaatttggtgattttagaaagtatggaaaagaaagttggctttggttgtgtaaatacaaaagttaagaaagttgaaagtgttgaagagataaaaagcttgatagaagagggaattgaaatattaaaaaacaatgaaaaattgaataaaaatttgtctgataatattttaatagaccccgattgtggaatgaggttattgccaatagacgtcgcttttaataagttaaagaatatggttgaagcaactaaattaataaaaatataattaattttcctctataagtggtttatatcctggcatatttggataaagccagtagtcagttttgttagtatataatccaatgatagaatacgtactattatagaccaatatatatttccctggttctccatagtatatagtcccagtaaatgtttttggtttttcttctttatagtcgagatttggatattcatcaacacctattggagggacggtagttgtaatatcatttatatcttttaaaaatatccaatccactgtaacattagtatttaaatttataagagcagttattgaaattggatagttatttcccttatttccattagtaaatgagttgctatattcaatatccaaagtgtcattaaatattgtaaagtttaagtcagtggttgaaattctttttaaatcataaatataaaatttatttaagtatttatttgaattaggaacataatccccaatatcacttccactgtatccaactctcatataaagttctggattatttccagtccaatcatacatatcccaacccactccatcgttatcgcttaattgtgtaaagaatcctatagtttgggcatgggatggagtaaagtttgctctaaatattaattcatatctagttccataagtttgttttgtatatacgcttgancctgctcctgcaattaccgttattttactattatnnatgataaagtatccaacagaatcccatttatctgggttaaagtaattgaaatcatcaaagaatataaatgtgtgttctgggtcttgtctatctaccggagtagttgaattgtagagtatgtatatatacccctgcccattattgtagttgtaaatttcatttttatttgctctaacccaaattactgatacatcgttatttccttctctccaggtttgaacccagtaaggtaaaagaataattttgttacttactgaatcccagccaattactctcagctctgttggagattgagggttatgcatttcactatagttaaagttactactatttaatattatacagaaagtacggttgtagttatcatttggaaaattatatatatttatctttttttcataaccccaggtgtagtaaaatttatttaaatagacatatgggtcaggaattcttgataattttatgtctctgttgatgactattggctttaatgcgattaactcaccattatttaatttttttgaatattttatgtcaatttcacaatataaatgtactactaatgggtcgtatgtaggtgaaattttaacagaactaatgttataggatatatttgagtagccataattcacattatttagtgattctttcgtttcattttttatatagctggttatatacgcaactgcctcacttgaagctgtaaaaaattttcgttctttcattattttatagcttgcatttacaaaggcatcttctacaattttatctatatttctatctatagtatttattaaatttttttcatataaacttacttcttttatttttatttcatcctctacttcctttgttttgtaatcaattgttgcataaaacactgcagatatcacaaacattagcataactaaaattatcgcattttgagagaaatacatggcaatccccttaatttcctaatatatataattcaacccttgaagaggatacattttttgaaagatacacaggcatatgtatatcgtagtttctatattttagataattataggcgtcatcatagtcaagaaacctctccttggatatatttacaaagtcctcatttccataaattacataccacccttcacttctgtttaaagttaaaactgttaaaatatatacactattactattattaaccccattggatttatttattagaaggttattatctatataaagaagataatgtttaagtggaattctttcctctaaaagtttttttgaatcattaactctatcaaaataatataaaagaacagcatcttgcaaagttccatcctctgatagatgttccatagtgcttattcctttatcaaaaatataatcagattttacaatatccacataattgttgttatgttcgacaatagatactgtccaatatgccatccctatgagaagaatggcagttccaattgctaaatcaacgctattaatcatggtttcaccacaatggtgacattgttaggtgatagtgttaaatagtaaaaatcagtgttttcatttgttttaattaaaaactctactggaagaggtgagcttaaaatccttatttcattaatccccacatttaaatttggagttatatctatattgtcaaatactgattttaatggttttttgtatatatatccatttactgtaaaaatgacatcagaagatagaagcgttactgttggttctggttctacatactttctaacaaatacccaatcaatgctaatatttccgttttgttcgtcttgaggaacaggatagtaaccatattttgttgaataatcatattttcttgcatagaatgaaattggtaaatctccagtatatatgtttgaatatatggttttatatatggcatcatctattatgaaattcactgaactacctccatctctttgaatctcataagtgtgccaattatcgtataaatctgggtcttgtaagataatgtaactatcgtaatcttgatttaatacagaagattcagctcttagccactctcctccccagtgatagttagttataacctctctgttatagtcatttccatttatgtttatataaaatccgccccactcctcatatttcttatggaaatttgcatggaatcttacagaagtatttggatagtatgtactaatggaggaaatatgcgtattattaatatcataaataatgtaattatgattattgtaataagtataatctaaacttaaataagtaaaattaatcccatttggataagtgtcatttacaaataatggattattaaagttgtaagtccattttgtattatccaaattacctttagaaaaatcatcaaagaatagggggaaggtattatctccatttgcagtcgttgtagctgttggatttccataaagcatatatattagcttatgttcatttggagctaaatttaccttaacccaggcgacagtatgcggagtatctattgtatttggctctatccaataacttaatggattaccatcttcatcaacaaaccttacatctccacaatctgttctcatctctccagaatttatataactttgagaatcaaaaacaatttttacatcataatcatttaaattttgatttaggttgtttattattaatattggagtagcatacctccaattctgccaagtaataaatggattaccattatttgtaacaaccctcgcagatgctgaaataatttcgctattgactttaaagtaaatgtggtctccattacagccatatagatttatagaatctccatatttcattccagtaatttttggaatatatacattttctttaaagtaaattaaatccatcccacttatacttaggttggcgttgttaaatgtagtatttacatttgaataaattttaaatgtgttgctactgaaattatatgttatagcctgaagtccatcatttgcacaaatttcgtctgaaatgttgtcaagttcttcatcatatatgtttggataaattataaaacgaatcaatcccttatattcactaaaattattaaataagtcgaaagttttttctttaatatctaattcatttgtaaaattatccaaatatgttttgttataaaactttccaggaaatttattattccttaaaaaataatcttttagtaacaaagctttatgaaatttttcagtatccttcttttcctctaatgctgtgagcatattatgactataaaccatataccctatataaaaaacactcaagaaaatgaaggcaattactattgcctcataagtaaatatataccctctttttgaaacaatttttctaaacatatgccatccctcatttaaacataattatttttttcatttttaataaatatatccaaaaccagttcaggaacaaagctattgggaagataataaaacttatgacatcatgaactacattataatttatcatatttgaataatttattattaatattatcctcaaaatatttgagatagtaataattgaaagtccaaatactgaatatgagattttatatttaataggaacatcaggagtcccaaagatataacctaaaaataaagccatttctaatgaacatgtgcatggtgagctaatctctataatatttttgccaactataatttcattcttgtaaaatttcaaatttaaaagtttagatagggttattgttaataagtccattatgtttccttctaacatttttaaaatgtaataaaatataaaaaaatatattaaaaatctaagtatgtatatagcatttttattgcccatttaaggccctcttcactttgtatatattgtccaatgctttattctttgcagctaaggttatattttttgaaatactttctgctgtagaggtccctctcgtaactgattttagataatagaatccaactatagatgctgcaactacaagagcacctaacaataatgccaattctaatgatatttgagctttattagatattatttttttaggtttcattttaatccccttataatttggaagaaacagaatattgttgaaataactatcaatatctcaatatatggcggtattggaacgctatgtataaatgattctcctatatttattaacttagttcttgaatctgaaagattatcattatctataactgtcaaggtaactggataaaccccctcttttttatatttgtgtattataattggatttgttgttgtatttgctggtgttccatctccaaagtcccagatataatatttaatatatccatcttcatcgtatgataaattagcgttaaactctacagtagttccatttattactttatacgtaaagtcagcaactggaggatattttggaggtggagaaattataacaatctttgttacactatccgttaagtttgtatcgcttttaacagttaaggttacaaagtatgccccctccttgctgtaagtatggataggattttgttctgttgatgtgctgccatctccaaagtcccagtgccaactaattattttcccaggggccacaactgatgtatcttcaaatcttacagtattttcatttattatttcatatgtaaagttagctaatatacccccaactactatttgttttgatattgaactacttgcgttatatttgtcaaatactgttaaggtaactgtatagtagcctggtctttcatatttgtgatgaactatcgtatctgttgtattgataacggtcccatctccaaaattccaaatgtaatatgcaatttcaccctccgggtcataagactgggaaacgaattctacatcctcattaggttcaggtttatctggatagtatataaattgagccacaggaggtctatttatcacactaaacttaacagttgttgaattaactcctcccattccatcccaaactaccaatttagcagtgtaattccctataggaaaacttttggatataatagttaattcatttgatgagtaattccatgcaacatttccattagaatcataaactgttaagttaaatccatatattcttgccatgggtgagtttggagatataggataataccctattaaggtgccgtagtaattatactctggaatcattctattagcatctgggtcataactatttattggactaaaggaaattgtatctttataacttgcaggatttggataaatatagagtttggctattgggtttttattgtctattacatatactgttttcatattttctgcagtataaactttcatatatattggataaaccccttctgaagtgtatgtatgtgtgaaagtatatggcgattttttgggttttatccaaacactgccaccatctccgaaatatatatgatgccaataccaagtccacgatgccggctctactattgttatatttattggatagtaagtaggggctattgtaggagaagcataaatttgaggataactgctgtatcctccaactccaattggtggtggaattccaacctctatatttccattatcatctataacgaatacatgaggatagtatagtccacttgaagaatatctatgagtagggcttttttcaaatgaacatgtcccatctccaaaacaccacattataaatattggatttccataaggcgaacaatcaaatctaacgttttcatttacactaacttgagttttgtcagcagttgctgttatatctatataatatccatctctcaattttacattaaattttggagtcgaaattacatctgaatagtagtataaattaaccgtatggttttctttattatattcataatcatagtaagttttatcatgagcagatgaagggtaaaaattatatcttgtgttttctacatcgtcaactactataaagttgagggtatctgatttccaccaactaccccacccataactcatccagaagaacggccacataaatggaaacttatattgatgatatgatggagtaaagtaagacttatatgtataaggagtttctgttccatctccaaaatcccacttccaatattctccccaagctccactcatttcaaattttatagtgtcattaactttataggttattttatatgggtcagtgtatgcatttccattattattattgtcatctccagagctattatatacataagtgtatgcctctccatcatagtgacttggtcctgtaacccagtaaatatacccccctcttgctctttttacttcaattccttcatccaaatatccaaccattacccttccagaatcatcaacaactaaaactcttggataataaagccctgactttgtatatgtatgttctggaaatttttcaaaggaaaaagttccatctccaaaactccatacacagaatattatatttctactaactgaaaaattaaatttaacagtatctccttctacaatttcatctctgctaacatttacagttactgaagttgtatcaacacttaaaccattaaactccctatcaacaggggtttctgagtaatattttattataacagtattatttgtgctattataatagacctcccaacttgtctttgaattcaacggactgccattaaatacatacttagtatttgctacatctccaacaacaagccagttgtaagttaaagctttcgaatagccagtattatttagataaccgcaccatgctactggataaggaaatggaaatgtatatgtatgggtggttgttctataattcccataatcagtctcagttaagtcaccaaaatcccatttaacaactccattatctaatatatcctgagctacagaatcgggggctaaagcttcaaatgttatcgtgtcatttacattgtatgcaatgatattggggtctgtgttataaactccagaactgttagttatgttcatagtgttaggatgtatcacaataacatatccatttactattgaaattataccaagaatgattaatggcattaaaatctttaaaagtttcataataacccaccaaaattttaagttatatttattgtcaattctttacatattgttatattatttttatcaatagtcacagttatgcttatattttttccaatatcaactggggcagtttctatattgcttccagaaattatgacaccgttatctgttggggtaaatacgataagggttttataactcacattaataattttattcgagacatgtattacataccccaaatctccaataggttttaatttcaaaactattgtttcattttttgtatatgaaaggattgcatagttctcaaatgtatcggctatactgtacatcctatccactatcaaagcatccgtagtgttatttgtaaatgtaagtgcattgtaataaataaacagtgaaaccaacattaaaaataatattgcaagtacaaaatcaacagataactgtccccttttttttattttgtttttgttcatattaaacctctttttttctaattttacattatcttttatgctgaaattaatactataatcatataataatatagtattattctttcttaatttatatttttccactaaaattggagactgtcaagttaagtttttatcaaaatattgataaaaaataataaaatatgaggctcacgatagaagttataaaggagagaatcgtagagaggaagctttttaaaaggaataggaaatcgatagaggttaaaatcttagcagggcttttgtattacctcggattatcgttaaggaaggtaagtttattcctttcccaattcgaagacataagccacgaatcggttagaatttattatcacaagattaaagaagttttaaacgagccagaaagaaaggaaagaaacttaattgcaatcgatgagactaaactaaaggttggagacaaatatatttatgcatggtctgccatcgatgtagaaacgaaagaatgcttaggagtttatatatcgaagacaagaaattacctcgatactatattattcgttaagagtatattaaaattttgctcgaataagccaaagattttagttgacggtggaaagtggtatccgtgggcgttgcgaaaattaggcttagaattcgaaagagtcaaattcggactaagaaattgcgtagaaagcttcttctcagtgctcaaacgaagaactaaagtattctacaatagatttccaaataatagtaaattcgatacggttattagctggataaaaagcttcatgatgttctacaactggatgaaatcgttaacttgacaacctcgatgggaactaataaggttttaagataacatctcgtgtttactctatttatagattctaaatttttaatgctaaatattaggtattgctataaatatttaatgcataaagatttaataatacatggttacatagtggcatgtttaataatatgtagcatttttcaaaaacttaataaaattttaaagaattaatataagcctaaaagtgcctaataggactttcgcaagaatacaattctaattgaatgataacaccgttagatatcaagtaaccttaacaaatctataaactgcaaaagtcctattcaatgttatgaggtggcataatgttacaaagatgtattaaatgtggaaaaacttacgatgtggatgagataatctacacctgcgaatgtggtggcttattggagattatttatgattatgaagagattaaagataaagtttcagaagaaaaactaagaaagagagaaattggagtctggagatatttggaatacttaccagtaaaagacgaaagtaaaattgtaagtctatgtgaaggaggaactccattatatagatgtaacaacttggaaaaagagcttggaattaaagaactctatgtaaaaaatgaaggggctaatccaactggaagctttaaagatagggggatgactgttggagtaacaagggcaaatgagttgggtgttgaggttgttggctgtgcttcaacaggaaatacatccgcttctttagccgcttactcagcaagaagtggaaagaaatgtattgttctattaccagaaggaaaagttgccttaggaaagttagctcaagcaatgttctatggagctaaggttattcaagtcaaagggaactttgatgatgcattagatatggttaaacaattagcaaaagagaagttgatttatttattaaattcaataaatccatttagattagagggacagaaaaccatagcatttgaaatatgtgaccaattaaactggcaagtcccagatagagttattgttccagttggaaatgctggaaacatctcagctatatggaaaggatttaaagaatttgaaattactggcattatagatgaactcccaaaaatgaccggaattcaggcagatggagctaagccaattgttgaagcatttagaaagagagctaaagacatcatcccatataaaaatccagagacaattgcaacagctataaggattggaaatccagtaaatgccccaaaggctttagatgccatatactcctctggaggttatgctgaagcagttactgatgaagagattgttgaagctcaaaagctattggcaagaaaagagggaatttttgttgaaccagcttcagcttcatcaatagctgggcttaaaaagttattagaagaaggaattattgatagagatgaaagaattgtttgtataacaacagggcatgggttgaaagacccagatgcagctataagggcaagtgaagagccgataaagattgaatgtgatatgaatgttttaaaaagaattttgaaagagttataaacaataatattttattattatattttttatgtctctaaaataacttcaaaataactccatagaaatcataaatctatatataaatctatatatacggtctttagaaaagttattaaaatcaatatggaatatttaaacgtcttccaaaaggagggttcgaaacagtttttaattttctataacttacagtagcatatcataataaacaatatcacaatataaatattgtttttttattaaaatagtaatatgtattgttatatcataatgttaatgaggaggctttgccttcgagacgaaatgttgatactaaatattaacgaagtttggattttggggctgtatctgttcagtcctaagtctgatgaacttatagtgaagggaatggtgttcccgatgaagctatgggctgaggacaacccatttccatagcttaccgattcgtatagtaagttattaaatgctatggtaagctatggaaacgggaaacggttaaatagatcttggattatattaaacattatctaattattgagatttcttcttaatcttttaaaggttttaatcatgtattaagaaaatttggataaaaatagaaagctatatataggagtttaggtataaaataagagcaaaaagtaagggtttaaatcgatagtccattaaaacaaggataaactctaaaaaagcaagattattctttaactcttttaccaacagctacgtatatgttgttagctccaattttatctccaaatttggataaaacctctatatttctctctctacacagattttctaccttcttcctacaagcatcttttgttttctccccaaaagatacaacaactatatttccatctatttcctcagaacctaagacaggtttttttatctttttgtataacccatcaaagtcctttaaatgtgtcacaatcattttagcatcttcaataaatggaaagtcctttaaatacttggttataaatgatatatccctttctctatcttgcccatacttctttaaatctactttgtagtagttgagttttccatcctgatattcttttataattgtcttagctgttctaactaaatcaacttctccacctttggttaaataactccttttatttccaatcttttttaataactcttcatcaacctcttcataatcaactccaaagtattcttttattattgagttatcaaagttatttatcctacttaaaatctttaaagctggaggaatagggttttctactttttccaatctcaaagctccacttataaccaaatcatcctcatctctcatctccaaaactccaggagtgtccataagcttaatatttttagttaatctaacccactgctctcctttggttaaaccagctacacttccagttaaagcttttctttttccagttaatgcgttaataatggatgattttccaacgtttggataaccaacaattccaacttttccttcttttttacccatttcttttaaggattgttttatcatctctctcaaaatttttgttcccaatcttctcttagcagatacaaatactgtattttccccaaaaacttctttccatttttctaaaatatcttttggaactaaatcagccttatttaatacatagattagctttttaccttttgctttgatttttttctccaactctctgtttcttgtcatctctgggtctcttgcatctaataccaataagatgacatcacattcatcaataattttattaactatttttttaactggtactttcttgtatctcataactctcaccatcaaaaaaatgttatattcctctcatttatattttttatcaatgaatatgacaaaataaatttataaatttatcgattatagaaaattttttatagaacttcaaacacatttacaaatagttaaattttcaataaaaaatatgaataaaaaggtgatattgtggttgtagatgcaaaagaagtagagatgataaataccttagtttttgagacattaggaaatccagagaaggagagagaatttaagttaaaatcattgaagagatggggatttgacttaatatttggtaaagtagatggaaaagaaacatatttcactgttgaattagatgaaagaaaagctggagataagttttcaaaggatggaaaggagtatgaagttatcgaagttcttcaagaattgccaaaaaacactgagctctatgcacacatagaaatggagatgggtaaagcatatattgtctgtcaattaagagatgaagatggaaaaaacacagaagttttaagagttccagcagctactttattgttagctttccttaaaaagaataaattagcaaacataataaaagcaataaagaacgttggaattagtttagaactttccatgcagaatggtgttggaggaaagccattatcttatgaagaattgccaaacgttgcaagaaggtttataagaagtgcaagaaaggttgagaaagaaactggttttggaaggttgtcatttgcatactatggagaaacaaaagatggagaaccaagatatagatttagctggctgttgccaacaattgccttatttgacttagatatagctaaaaaagtagaacaaaccttgggaatcttaaaggtttctgaataaataaaattttttgaggtgagatgatgatttatgggattttgttaaatattccagaaaaacatgctacaaagtatgaggatttaattaggagaataattggagaaggaatagcaagaggagatatcttatcatttacagaggcaagatacaaaggagatgtcgcttttgtcatgcttgcaaggtcaaggagagcggctgagaaagtttatcagcaacttaaagagcatccaatccatgtaaaggttatagagattgaaggaaaaggagattaatagttcataatttgtgaaaaaaaattcttaatatttttataccataatttatattttttatatgtgaagtatttcattatcgtgtaagaggggagaatatggagcaatttgattttgatagcatcttcaataatgcagtaggtaatatgaaatatttcattaaaaaagttaaaaaatacgaagagattaaaaagcatgaagatatattaaaaaaagatttattaaacgctgtaaatgtgtttatagagaggtttagaaataatccatgcatctgcaaaaataggaataatcacagtagttgcaccacaaacgcatgtggggagatagaaaatcgcatgaaaaactgggttgagaagttatttgaatatagtgatgatgaagaaaaattaaatgaattttttaaaattatagcaaaagatgcaatgaaatttgttgagttggattttgaaccgttgtatattttatgtggattggaggaaataagagagacggcagaagaaaaattaaaagaggaactaccaactgaagagtatttaaaagttatggaagagtttgatgatttaattgaaagaatgtctttggttgccacagctgtttatatggagttcgaagatagggtttttgaaagaatgggcataaacaaaaacttaaaatataatattatcaagttgggattgaaaaagatgaatattaattaataaaaattaataaataatacctattttttaatatttattattacaaagttttatatattttgttttacatagatgttattgattaggtcataacactaaataattaaaaaatatattaaaaaagaaaggtggcttttatggaaaaaatctttccagacattttagaagcaataagaaatgaagagataataaaagaaagtaaaaaaattcctatgccatattttgggttgtttgcattggtaatatttgataaagttaaagaacttggttcagaaacctcattatatgaaattggtgaagaatttggaaaaatgttatctcctaaaaatattgaagaattgaaaaaaatattcaaattaatgaattttggagatttggagattgacgaaaataaaatacttctcaaaaatccaccatataaaataaagctatctaatcctccataccaatgggtatctaaagaagaaccaattcatgattttatagctggaatcttagctggatgtttagaagagatatttaaaaagaaatttgttgttaatgaggttgaatgtgtttctcaaggaaaagataaatgtgtgtttgaagttaaggaagttgatgagctaaataaataaatcaaccaactgcatatctttaaccaaacctttatcagttatttttagctcaggaatcacagggagagagaaaaagctcatacttaaaaatgggttctcaaaagaactccaaccttctatttttttatacaaagcattaatcttctcagctatgtattttccatcatctcccattatccctccaactggtagaggaagatattcaacaacttccccatccttagcagctataaatcctccaccaatatcttttaatttatttacagctaaggctaaatctttctcattatttcctatggctattacattatgagaatcgtgagcataggaagaggctaaagctccctcctccaagaagttgtatattaaaccctttccaatatttccagtatttttatgcctctctataacgaagattttatttatagcattttcattcagtaatatttttatttcttcagtgctaaatattagctcttcagttattagagaatcttttaatggttttattactctaataaatccatctctctccttataatcaatccctttaattaaaaaatcaccttcgtttttgtattggtattttaaagtattcatgagcttttcgggaatttttctttttttatttttatttagttcatttaaaacatcatctaagaatcttccttttatgacaatgttataaactttaaaattgtctaaatcttcaaagattacaaaacttgcctcatttccagctttaattcctacatcaaacccaaaataatttgctggatttattgtaaccatttgaatagcttcaattggagaaacatagtttgtggcttttcttaaaatatttaacatgtagccgtctaaatctttaatacagacgtcatcactaaccaacattatattcctaaaatcttttatctttttgcatatattaagcaaatagatgttttttgatgctgttccttctctaatcattaattttaatcccaatctaagcttttctaatgcctcatcttcatcaacactctcatggtcgctcattattccatgagatatatatttgtttaactcccaaccttttaattttggacaatgcccatctatcaatttattgtattttttagctacttctatcttttttaacatctcttcatcttcatttattactgcaggatagttcataacctctcctaaacctaagacattatctaaaagaatgagttcttcaatattctctgctgtaatctcagctccacttgtttctaagtttgtagctggaacacaggaaggaagcataacatagacatctaaaattttggcatcattcaacataaacaaaattccttcttttccagcaatatttgctatttcatgcgggtctataactactttgctaactccgctttttaatacaaatttctcaaactctgatgggatgagatgggaagattctatatgtatatgcccatctataaatgttggagataaatattttccttttaagtcaataactttaacatcctcctttattttttcaattatcttatcaatttcatcatttaaatccacaaaggatattttatccctctcaactgcaacatttcctttaacaacctctccagtatatacatcaataatctttgtatttttgaagacaatcatagagctctccctttaaccttatttatgttaaagaaactttttaggagaaaattaataggaaaaaattaaatgaaaatcatggagtttcataacccaaagctaacgcttcggtttcatcaaaaattattaaattatctttatagcaccctacctttaaccttatttatatcaaattttgctgtttcagcaatagccataacagctaaaacccctgcctgcaatgggtctccaacaaccaaatcagcaaccttaggaacagagccaaacatctttaagcttatcacgggaatgccagtcttttcctttaattctttaactgcttcagttatcttccctcccattaaagagccagctaaaactaaaattcctactcgtggaagagttgctacagctttaacagcctcatataaattttcttcaccaactattggaagagtatctacgctaattctctcccctcttatattatgcctgtctgcctcacttatcgcccctctcgcaacttcagcaacttgtgcccctccaccaataataataactctcttaccataaatcttttttaatgagctgtgaatttcaaagctctttacacactcacaactctccattcttctctttagctcctcaatatctttaatcccttcaacttccatataaataaatccaattttaccatcatctttaatgaattgttgagtataggttatattccctcccaattcagaaagaattcccgtaagtttgtgcaaaactcctactttattttctgcctctatgctgattccaatttccatgttctcacattaaatttatttaatattgatgaaaatcatcaaaaataatattatttaaaatttaaaagaagctatcgcctatatcattggtaatgttatctatttcatcagttatgtcctcaattacattatctactcccttgtcaatttcttctattgtgtcttctattgttgtttctattccttcagaattatacccatcagcttcgttattttcgttattatttatcacatcttctattgcatcagttatcaactctccagctataactccaccagcaacagctgcagcagttcctaataaattgctactatctctctcaactacaactgttctattggctgttccatttacagtcttattctttctactaaatattaaatatcccagtatcaatccaaaaccaactaaaataaatgctaatccaaaaaataaaattaataaggttagtgctgtcataaccatcacataaaaattattttaatcttcttctaacagcttcagcatgcccaaacaaaccttcagcttcagctaatgtgataacaatatcagcaatattttttaagctttccttatccaatttttgatatgttattttctttaaaaatgtctctacattcaaaccagaactcattctcgcaaactgtgaagttggcagaacatgattagttccagaagcataatctccaacaggaactgggctatactctcctaaaaatacacttccagcatgtttaattttatttaaaacttcctctggatttttagttaatatttcaagatgttctggggcatatttatttgagaattcaatacactcttctaaatcaccaattaatatggcagagttttctaaggcttttaaaataatctcctttctttcagctttttctatctcttcaaatatcttgtttttaatctcctctgccttcttttcagatgttgttgttattacacaagaggcgttagggtcgtgttcagcttgggcaataaaatctaaggcaacaaactctgcattagctgtttcatcagcaataattaaaacctctgaaggacctgctaagaaatctatggcaacttctccataaaccatctttttagctgttgttacatatatattcccaggccctacaataatatcaacctttgggatagtctctgttccataggctaatgcccctatagcttgaactcctccaaccttataaatagctgaaactccaacaatatctcctgctattaaggtagctggatttcctttcccatcttttgtaggtggggaggttatatatatctcttcacatccagcaacctttgcaggaattgttgtcattaaaacagttgaaggataaaatgcccttcctccaggaacatagcatccaactttttctattgctctaacaacctgtcctaaaattattccattattttcaacatttaaatcttttatttgctccatctgctttttatggaagaaataaatgttttccttagctctctcaatagcttcaacaactttataatcaactgagttataagcttcttctatctcctcatctgtaactttaaaatcttctatttctacaccatcgaacttttttgtataatattttaatgcttcatcccctttttctttaacatccttcaaaatctccattactgttggcaatatttcctcaaagtttgctttattcctattaattattttctcctcttcttcctttgttaattctttaatttttttaattatcattccagtcaccatagatttttaattgacaaagtttatatatagtcagtgcttatattatttactgtataagaaaaaatcaaggtgagaaaatgatactcttcgagtggggaacttataacgctttatcaacattaaaacaggcagcattattggggacaagaattacagaaattccaccagcagtgttatcaagaagattgccatccggatactatgagagttataaaaagttaggtggggagtatttcacatcaatcttagctcatgggccttattatagcttatcatcagagaagggattgaaaggtcatctttcagccatagaaaaagctacactatgtggagctgagatatacaactaccatcttggaaaaagagtgggggatgatttaaactaccacttagaagtcttaaaaaaattcagtgaagttaataatgagatgatttactctccagagccagcaacaaatattggagagtttggaacattagatgagcttgaagagttaataaaagcggctaaagaggaagatataaaaattattccatcattacagttagaaaacatattcttaaatgaattgggagtttatgagaaggatgatttagatgaagcagctgaaaaggcagatgttgattggtggctaaagattttcagaagaatggataaaatatcagattatataatgcatttcagattttcacaggttattgggcttaaatatggaaagagattctataagaagagagttcctttaggaaaagggtatccaccagttgagccattaactgaagctttagctacatacttagtagataacgctacaagagggggatttaagaaagttctatttgtctataccggattgccagaggttaagtatagggatttaattgacttgtatgcaatgattatgaagaaatccatcgacaagttgatgagtagagagagccaggttgaatatggcgatttctataaagttatgagttcagaagaggaagaataaattttctattttttagcttaattttatattgcattaaatttaaaatattttgctttttaatttttaattaaataaaacttttaaggggagagaatatgatatgtttgccagtagttgaagatagtgtagaaaaagcaataaaaacagctgaaaagtatttagaaatagcagatattgttgaatttaggatagatatgcttaaagaagttagtgaagaagatatagagaaatttgctaagtatccttgcataataactgttagagcagattgggagggtggttattggaagggaaataatgaggaaagattaaacttaataaaaaaggcaattgaatgcaatgccaaatttgttgatattgaattgagagaggagaaaaataaagaacttgtaaaatttagagatgaaattggttcaaaaacaaaaattataatttcttatcatgattttgaaaaaactccttctaaggaaaaattggtagagattgttgaaaaagctcttagcattggagatatagcaaaatttgcaacaatggcaaatagtaaagaagatgtcctcaatatcttagaagtgataaataaatatcctggaaagattattggtattggaatgggcgagaaagggaaactaacaagaatcttaggggtttattttggctcaatattaacgtttgcttcatataaagggaaaagttctgcccctgggcaggttgatattgatacattaaaagaaatctggagactaatggatttaaagtaaatttaaatttcttagcataatttcagctaattgtttatgttctctacctccaacttttttaattattgagaaatattttctaatgtcatttatcatctcttttttgtcatcttcattaatttttatatttttgttggctaatcttgagtagataactgctatctccaccaataagccgtctgccctattgtatggctttgggatgttgtttaaatatatcctctttatttcctctccctctaaaatcatcaatctgttttttccaaatttatcttccctatcaacaaactttctttcgataactttgtaaaatatagcataataagagctttttagataaggaatgtcattataataaagataatcatcctcatcatctaaaactgcctttgctatctcaattggtggaaccacattaactgaaaaataatcttcagttaaaagattttcataagtatgagagccagaaaaaagatgcataataacttttttatctttaaaataaacaccaattggggctttattgtctctattattttttcttgttgttacaaccacttcacttatcatggttatcccaaatttacttttatgctctctaaatctcctcctcttctgtatgataaatttatcttaactcttcccttatctacctttttatttaatggaattaccaatggaggattcagcattgatgtttgtccagctacatgtttatcatccaatattgtataggttctcagctttattcctaagttttcacagcttttttcaagctctaactctatattatagcttacttcaataggatttgtcttatgaaaatcaacttcctcataaataacctcttcagaaacttcctctgatttaatatcttcatcataatagatatggctcatttttgcctctacaagttgtatagttgatattgccttagctgggattattttaacatcttcttttaaaaaacctctttctattattgaattcataactttaacttgtggttcaataattaaagcagtgtctaaaagctcagctataaccacatcagccttctctttaaagttgtaagttgaggcatctccttcaataatctcaatgttattaaatccattaacttttatattttctttagcataatcataagtaaaagggtctaactcaatggcataaactttttttgctttctttgcagcaatcattgctaaaattccactacctgttcccaaatcaaagacaacgtcatcttcatctacaactctctctatggcgtttttaaagatagccaatctctcatagtcagttaataaagagtaatgccattgtggaacctttagtcttaatttcatgttatcccgtcattcatatatttataaacgcaaataaatttatagattgaaaattgcgtaacctatatgcatcaatttttcatatttttcaaaaatgaaaaaatatatataggggataagttaataatattatcctgtgggggaataatacgaaatgttttgctattttatcataaactttgagatatggcttaattagataatgttaaacataaggggaggggttttacgcctaaaaccatatttatataacatttttacagacataatttaaaaatataatttttggtatttaatctcttatcatacccctttctttttgccattttctccttaaacctaatatacaccctcctcccctaactcctccaataggcacttgaggagttcccaaacagttcatacatcttgccataactgaagcacctaaagctaagccatcctcaacaaacacaacattttcctcaactttatcccaaatttctaaagttttaagcttctcaataattaattctggctttctgccagtaatcccagcccttcctgtaattcctacagctgacttttcactaattaatccttttttataagctaactctaccaaccttctaacaacttcactcataacatagtctaaacagcacatcaacgttggaatatcactcttttcaactaattccctccccaattcttccaattttatcaaatcactaccattcttaccaacatcacatccaattaatgtagttccagccttttcagcggactttgggtctactgggacagttccaaatctatcaacatcttttgggacttctttaataattatatatttgtgcatttcttcagcatattccttagctaattcttcatttggctttccttttatatttgctaaatctaaagccgctccagtcttctcatctatttttccagaaccccttgcaattgcatcagctatagctccagctaaaccgcataaattaccaataacctttgcataaggtaaagtgtcattagttattctaccagccaaggttgttccaaagtcaatactcatacaaggatttctgaaatctacatctgtccatttacttccaacttttattcctgcagttacaagctctccttccatctcgttagctacaacctcctttcctgtaggaggcagaactccagtaaccgctccatcaaatataatcttatctaaaaaagaatatttatcaaacggctttggtatctgttccttagtcattgctggagtcatctttgctggaggaactccagctttcatacatccttgagctaaggcaataatcatctctccaacttcttctggagatgcaaaacctgcagtaactccagtacttctaacaacaaagtgtaagtcatcaacagttagtccagctttttttaaactctccaacaaaacctctttaaccatatctgcaactgcctctcttgttaattcaaccccccatagtgtctctccaaaaacttcttctcctttctttggctttctgacatcccttgtcatcttcacgtgcttgctaacaatgtaggttttaccagtatccatatttgttgctgttatgatggattttgttgttgtatttcctaactcaactgatgccactatatagtaaggatttctttttaactcaatcaaatctacactttgtgactttgcataggcaatttttggcttctttttaaacagtcctgagatgacatcaaagattcccatgctacccctctctacaaaaatattgcaataaaatatttatctctggcttatggtttataaaatctcccttacaaattttttagatagtgcaataattgaaactattggcggaactcccaaggcttctttaaataaagaggcatcgcaaacatacaacccctctctaacctcaaactcatcaacaactaagcttaaactcccccctggatgagaaccccttggtatagttgtgtatatatcatcaacacccaacttgtataaatattttgttgccttacatatacctcttgcaagagttttgaaatcttccttagttatctcttttttaacgtcgttatctaaaaccactccattgttttcatccttaatctttatcataatccccacaatatctttctctttcacatccttataatctttttttatttcgttaattagtagttttgaataatgagttgccagcatgaaatttttgtatttcttataaacaagcatggagatgtctttatttagatagctatcttctaaaatcccaccaacagtaacaaaggtatctataaataagttttttccaatattctcatcgtcaatcattttttttagaattcttggagaattaatgcctccagcagagattatgagatttttagctttaatctttctacctttatcatctaagatttcgtaataattgctataatttattgcttttatgttaaattcagtgattatatttgcatttgattcttttagataatttaaaggcgtccatttagctttgcatatctttcttgcacactctccacatttattgcatctatcaaaatctataaacttctccatcttttcaaagccaagttcaataaaggctttatcaatatcatttaaaaaatcatcttttggagctttaatttttaattcttcccaaatttctttatagatatctttgtctattttgtagcccttaatttctgtttttatggcatttcccaaggaataaactccactccctcccaagccatagacataatttatttctacattctttccttctgaagcataacttggcttttttcccttttctattactgccactttatacctatatctcaattccttggctaaggtggctccagccactccagagccgataatggcaaaatcatacatggctaatccctatttttgcatatatttattgtataattctaatattttcatcttcctattttcattatacttgttgttattactaaacattgagttattaatcaatctttcaaaagttcttctatctcttgaagataattttaataaactcagctcttttacagcttttgcacattcaatttcagaataaagtctccattcttgaaggatatccatatattttttgaatttttgttcatcaatagcatctttggtgtataatctatcttgattaatgaatggaaatgtatttataaaatcaaacttttctttaaaatcaggttttgctattgaattaataatatccaatatttttttcatagtattttcttctccagataaaaaactccacaattcttctgcaattaaaacctctcttttatcaaaatacttggaaaattctattaaactactcatgaatctatctttatcatatccacaaggattttctggattttcagtagggtcatagggaaagccaataaaataataaacttttttatttggttttgtttccatcatataggcttttccataaagaattttttgtttttctcctctcatttctccagcattaggtctaacagtttttaactcaatcattacaactttatctttatcttcaaaataaacatctgcagtaaattctaacccatttacatattcagaattttttgaagtagcttctcttaattctttattttctttttccacatttggcaatctttctccactttttaaatcatttataatctccgatattttgtctctaacacttcttttaattttatagtttttaaatgtccttttttcaccgttagataaaatatgagcaatattttcaaagtagctctgccccaatgttgtgcttaatccatgaaaccactgtgataaagttaaaaactttaatgcttcagtatcatcgtttatcccaatcttcccataaaaagcccttaaaaaagccatatggaatggcatgtttcttatttttatgtcttcatctgatattgtatcaaatcttgattttaatactcttattgtctcaatgctaattttttctataacatttttacttagtggcatagctattcctccatttttaattcaaagatgctttcatagtatgggtttctatctctttctgttctatttaagaccggtcttttaaactctctaactaaaataagcccacttttctcaaaaatctctttatataggttctttttatcattaactacaatgaaaatctttgcgtcttcatttaaaaatcttttcatgttgattaaaacatcggatatgccttcaatatactctttttgtgctttttttgaactacctttaaatttaggtcctatctccaactcatccaatcttggaatgtcaaaaagctcataagcataggcatgctgctcatgataatcaatctgccctaaataaggaggagatgtaaaaataccatcaatttttttgtttttataaagttcataaaagtttgggtgtttttttagttcttcttcaatatcaacagtccttgaatctccattaatgattaaataatatgcatctttcctaatctttgaaaattcttctattctactaattacatcatttgtatattcttctaagtgtcttaaaattgtttgaactggtctgcaaatttttttatgcttatagcaatagtatgggtcaaaaactggctcttttagtgtggctaaatcaaaatgagtagttcctctaacagaccttgccgttctactcaaaattatcattgccactttttttattgtttcatctctgcagtctttaattaaatttaaataaaagtttaattctgccctaattcttggagaataccacttatataaaaatggcttatctttaaaaatgtcatcaaactcatcatcatttttgcagtatttttccttaagttttttatactctaaataaaacatttccatgattttttcggaatagctatcttcatcaatttctttttttgataattttcttttatattctaaggtaaagtattttttgttgtatttctcaattaatttatccatttctttaacaaattcatcatctcctaaattttttgaaaattcctttgttttatttagcatatctaataaaattttctttaatttttgaatatcatatttctgcaatttaacttcagcaattaaacagttaaatggtgatatatcaatgccaatagaattaatgcccatctccatacattgcactaatgttgttccagaacccataaacgggtctattataatatctccaacgttaaaatgcctctttaaaaaatactctaccaattgtggaataaactttcctttgtatgggtgaattccatgaacatgtttagttctctccttctcagataacaaatcaaatgctaaatcccaatccaatttaaatcccaatttttcttcccattcttttcttttttcaaaaaataattttttataatagttttcaacctcatcaatatctacataaaccctatttttgattttatacttattgactcttccatactgcactaaatatgaaatattatgctctttaatttccttaccaaacttttttgttaatattcttgatgcctcttttattgtgtaaagtttttttgctggctgtatatctaaccatgcatccagattcataattcctcccctatatcctcatcctcatcaaaataaagcctataagtgtctatatcataacccatcttgtttataaacatcctaattactcttcctgggtcttttgattttgtaattgctctaccaacgattaatatttgatattcttttaaaagctcttcaacattctccacaccaactcctccagcaattgctaataagcagttttccttaaatttccattcctttttaattccaaatgtctcctcatcaatccctctatgcaagataacaacatctggctttaattttaatgaatcatataatttttgaggttcagagacgttcatcatatccaaatagctgattaaaccacatttttgacattcgtggatagctttaattattgttgattttggtgctactccacttattgccactgcattagctgttgcttcaaatgccaatcttacctcaacccttccagtgtctaaggtttttaaatcagcaacaataaagccatcaaaatattctctcattatttcaataacctctaaaccaaactttttaattagtggtgttccagcctctaagatgatgtggtcgctatttggaattgtttgtaacaaaaattccaaattctccatagttgggacatccaaagcaatttgtagatatggaggatactccaatctaacatccctaaatccaactaatggatgcaaagctctatatttctctttctttaccttctcttttgaaggatattcatttaaagctctgtttatagctaactttgctgaggcatagaagtattggaagagttttcttttatttaaattggttattggaacctctgggacattaacagagacaacaacctttaaatcttcatctaaatctaaatcagcaactgccttggcaactgcatactgaataactccctgaaatagctcatcctgtatctcactctctatattatgccttggaacaactaaggttaatggtttaactattaaattaggtcttaaattggcaaaaacacaatttcctcttgttaaagcatttgtaaaggtattctcaattaactctcctttccctaatgcaacattaactattgccttaatttcatttcccaaaactgcttctccaaattttatcatattaatcccttgtagctattttatttaaaatttaacaattttccactcgcatctctatatactccccgaacaacctttttagaaaaggttgatcaaaactaaatatcaataccttataatgttaataataaatcttcttaccgcttgcatctctcttatacttcccaaattctctaataaatttcaacttatctccccaaaatactggcccatccttacaaacacaaagtccctcatcatctacacaacactgcccacaaatacctataccacacttcatatacctctccattgaaacctgaactggaatattatattcatttgctatttctacaacctttttcatcattatttctggcccacaagttataattaaatcaaatttctcttctttaaggacttctttcattttttcagttgtaaaacctttaaatccaaaactaccatcatctgtgcaaatctctaatctgctaactttttcaaatctatccaaaaataataactcttctttagttctcgcccctaatatggttgttatttcaattccctgctttgaaaattcttcaactgctgttataattggtgcagctccaatacctccagcaactgccaaaaccttatctcctattggctcaaaatatgttccataaggccctctaactcctattatatctccttcttttagttcatgcatttttttggtaaattctccaactcttgcaacactaaaactatttttagaagaaaatccaaatggtttttcatcaactcccggaagccaaagcattgcaaactgtcccggcttaaaatcaaaatctttatctactacaaatgtttttactgttgggctttcttctattatttcttttattctacatataactggtttttccataatatcacctgaattataaaattttctattaaaaactaaaaataaaataataaaaactaaaaacttaaatttattaaatacttttacaaatcatttattgttctaacgacttttcctttttctatcaattttacgattaaatctaagctaactggtttataattaataacttctacagaaacattaatactcttccttttgggattaataaatggatattcatctaaatggtttgcgtgatgatgcccatgaattatccaaccatcgaagtttaaagtataagagctgtctggattatgaattagcatgaatttatagccgttatattcaataactctaaacttctcaccaaacttgtcatgatttcctcttataaaaacaatctccccatttaacaactctaaaagttctcttgctttctttgccttatttttgcttaaaatcaagtcccctaaaaaataaacaatatccttatccctaaccacattattccaattttttattagagttttattcatctcctcaacatttgaaaaaggtctattgcagtattttataatatttgcatggttaaaatgcgtatcagagatgaggtaaatttttctcatagacatcccacaaaattatataaattatttaaaccatgcatctaatgttttttgcttagttttgtttgcaattaagttatagagtttatcaacatgctttttaaccctatcataattaaagtcattttcatcaactaagaattttataattccctctttatctggcaattttaggcttaatgaatagttatcggtaacctttggctctttaaatatcctcttaatctcatcgtagtattcaacctcttttttcaaaacatccttagctacaccacttctaaccaattcataagcccttttaaatcctattcctttaactcctcctggattatagtcagttcccataaatatggctatatctatcaaatcatccaaagaaattcttaaatcctctaaaacctcatttaattcaataagttctggcatctcctttgtagttgttaaatttctaacaactctcggagctccatataacaaggcatcataatcttgacttacaactgcccaaacatctcccttctttgccatatagcttgcttgtgcctctccctcagagggagcttcaacatacggaatgcccatcaaacttaacaaatatttgcagttttcaaccattttcggagttagatagctaaccctctttgcatacttagcagcttcttcaaaatcctcctttttaattgcctctttcatcttaagttcagctttctctttcatctctctcctaactttccttgttttctcctttaactttggtggctcaccatcaaaaacccagattggagttatatcattctctaacaaatgtatggttttataaaaaactccgttatatgctgaggttatctctccttttctatttctcaatggagaaccatctctcaaacgtatagatgttaaaaactgatataatgcattcattccatcaatagctacttttttcccttttaaatcttcaaaggagataatattttttggaataaaatcaccaaactgcactcccatgttatcccctacatttaatcttaactaaaaattatagtgtttttcaaaattaataaaatttattgataaagatttgaacgccttccaaagaaggagttcattaataccttagttatttaagaagtttgaaaaacactatataactgcataaaagatatttataaaaaacggtttaattttttaaatttctatagaaatccataaaaatagacaaaagttaaaaattattgtgaatactgctctgctatatctccaattactggaagcttaaacttctctcctttgtatgccttatacatacacacaatccacaaaataaaagctgccaaatttaccagaccacttagcatccatccatagggtataaatgccaatattattgataaaacccaaagtcctccgaatagtattatggattgaactgcatgaaatttaacaaatttactttccttttctaatatatagaacaatattccagttattactccaaatagataacataacgctccttcaatattttcatctaaaccgagtgaagtttttcccataaatatcacctatatatacgtaaatttttataaaaaggatgaattttattgtgaagagtatatcttacctttgtagtatccaacaacgatttcatttgtatctggatataaaattatttgtattgcagatttattgtcttttgaaacataccataacaccattccttctccagattgccctcctcctgctattcctccactactttcaaaatatccagatttttttattgcctcattcagcttttcaaaatcattagtggttatttttctctttggaacataagtcaatacaatagactctccttcattttgctttcctgttgaaacatattccattaatttaacttctccaaacacttcatttaatattggtctaattttctcatcagcttcttttgcagttcctattggctggacatcccttattgaattgtaatcaaccccttcatcttcattttgatattcttcctggttttcattttgttgttgttgcactacctgttcttgcatattttgaatctcttcaacattctttcctccaatgcatccgctaatggttatgccacatcctaaaacactcaaaaatattaaaaatattaaaaatttcctcatagtcccaccgtagaactttataaaaattcttatgcttgtcatgcttatataaattttctatctttacaatttttaattttggctatggaaattattgataataatacaaattgtgaaaatattatccagctaaaatattataaataagtaatttaattttttaaagttatataaaaggtaaaaattttacaaaaataaaaatagtccaatttatctcccattactcataagcttttccttccaaatcatgtcaatatctacactacctccttggaattcaccaatatctgctatactactataggtttcttcaatatctccctcaatctctaaataagccctttttagctcctctatattcccttcagttgttttccacaatcctctttgataagcctccaacaatctccttgcaatctcttctaaggcatagatgttgtgttccttaaagaactttctattctcttcatttttcacgaacgtattaaatatctcatcaaatatccaattctcaacctcttttgttgtagcactccagccataaactctgccaattctcttggctatatctccagctcctttgtagccatgcctcttcattccctcaatccactttggatttaagagttttgttaagctaactctctcaatttcttcttttaaagttcttacttcaacattgtttggatttcttgtatctccataatatgccttaacctcttctccttttaaaacccttgcggcatttgttaaacctccatgcgttccaaagtagcaacaacatccaaataaatcatactcatctgtaacaactttattaaatgttaaatcaactgtctttaatatattttcaaatgcattaatcgccttctttccatagacatcctttccataggcataggagttccagtagataaatgcatcttttaaatcttcatcattttcccatgcacttgcatacactgcatatttaacaccatttccataagtgccaggaggagagcagaagattctaaatgttgattctctaaatgataggcctttatttaagttctcaacaacatgcttctttacaaagttcatctccaatggctcatctaagttagcaactttcattattgcctcatcaacaagctctatgcagtttgggaacatatcccttgttattccactaactctaatggttacatcaatccttggtcttcccaactcctccaatggaataacttctaagccaacaactctccctcctctataaactggcttaacacccaatagatataaaatcatccccattccttccccatcagcccacattatatcagatgccatccaatatagagctatgttttcaggataccttccctcctcctctaaatatctattaattaatttttcagctaataaaacccctactctataagcagatttcgtaggaattcggtatgggtctaatgagtaaaagttccttcctgttggtaagatatcatagtttcctcttgttatcagcccagaaggccctggctctatatatttggcatcaatgcctctcaacaaagagccaatctcatctgatttttcaattctctcattgatatccttaatcttctcctctaattttttatcttctatactctttccatttaatacatctgaaactttcttctttaggtttttatctttatactcaaactccatagggggaagccccctattgggataccccggatgcattgcctcgcttcgctcggcaatgcctctccttttactattcatagtattattctggatgaatatcgcctctaaaatactctttataaactcaactctcttctctccacttggaagttctccaaagatatgcattccatcattgcacttcgagttctttatcatctctaagatatctcttagctcatcaaatatctctttaaagttctcatggattttcccttctttttcaatcttctcaattttttctttaattttcaataaattggtttttttaacttcctcaactatcaaatgctctaactgatgccttcttgaagcatccatctcctttaaatactcctctatatagctatctaatgtctccaactcttcataaaatgcatcaaccataactgtttgcatgtgatcaataatagttgcatagcttcttctctttgctatagttccctctggtggattatctgaattataaatatagagatgaggaatatctccaatacagatgtctggatagcattcgttagataaaccaacgttttttccaggtaaaaattccaaagttccatgagtaccaacgtggattattatgtcagcaatgtcattaaaatatttatatgatgctatatattgatgagttggtgggcaataagggtcgtgtaatatcttacaaactcttccatcacatcttgccccagcacatcctctttttggttgaacacaaacatagacattcccaaactttaaaccagttataactatcttattttttccattaactttataaatcattcctgctgggatgtctttaccatttaaatctccccatgtttctaaaattttattttttacattctctggcagtgtgttgaagtattcataatactcttcttcatccattaagtatagatatcctcctttagctataatctcatttacggtagtccatctaaactctgaaattgccttcttctgcataattagctgagctaactcctctccattttctggaatattttctacatagtagccctcttccttcaacttcttcattatgtttataacactttgaaagctgtctaaatgggcagcacttcccacagttgcctcaacagatgcacatgcattgttatgcaatataaatataacctttctatctttcttaggtttgtattttagctcaatccatctctttattcttctaacaactttgtctatcctttcctcaataccaaacttcttctctaagccgttctcattttcagtagttccaatgataatcggttctataaccccttcaaactctggcaaggctatagtccaaccaatatctgcagataaaccttgctcatcttttttccaatcctcatagcttttataataactcattattggatgaaatactggcacatctaactttttaagtatctctactccagagattttgtttaaattagccttatcttttacagttcccaatggaaatgacagtagattgattaaggcgtctattattggcttatcatctttaaggaagtattttaaaacactctctccactacctaaggcatttaaatcctcacacttagctccataggaaaatactggaattacattgaattctttgtccaatctatttaatagcttctcaataacatccatatcatcattaactaaataatgccttgagaataaaatccccaccgtatattttttattaaactcaacgtcttttaaaaattcttctaattcttcataaattttgcctctataatagataccttggaatggatgctttacaacatctttatctttacccattagatataaaaccatatttttgaagttatctaaacctccataagttataaataaataacatttagcagatttttcagaattccaaaagtttgggtcttgggcaacaactataacgttttcattgaacttctttatcttctctaaatcaatatcatctgatgatgttctataaataaaaactaaatcataatcttttgcatcctctaaaaactcatcatcaattggatttctgttagaatatattttatattcaacatctactccttcttttttaagctcatccaacgccttttttaatattgagcaataagatgcccacatataaaatgtgattttcataacaccaccgtaatattaataacttataataactactttagtgctaattttttgtagattttattactacattattacaattttagtatttataatttgtcattaaaaatcatgataaatttcataaaaaataaaaaattaaaattagtaaatagaagctccatcattgtttggtttagttaaaataacctttccatacctatttaatttttcttttaccttttcaacattttcatcttcaaccatggctatataacttggacctgttccagataaaccggctgttattgccccagcatctaatgcgtctattgctatgtttgttggaaagtttaaagctgatgcataaagaattccatttaaaaataaagctttgaaatagtttccatttatagcctcattaaaggcaatttcaacataatcctttattagcttcattctatttacatcaacattcttttctaaatttggaattaatattaagacgtttaaatcatctctcatcttatctctttttaaaatttttctttctatattgtcagttattgttattcccccatagtatgatgcagtagcatcatcataagctccagtaacagttaatttttcatcaaaacttgattttatccctaaatttaatattagctcatcatctattttttcccctaatgcatcaaatgttgccaaaacaactgcgttagaagtggctgaactactactcaatccagattttataggaatttctgtctttgtttcaacataggcagagtaattcagcccaaaataatctaaagtatttttgacacatcttactattaaatttggcttaatgtttggattatctaaaactttaccctctattttgttttttccatcatctataagtttaactttggcataaacctttaaatctaatccaaaagctgaacccttacctgttgctatagcgtttattattgtcccagatgctaatgcataggcttttccttccataaaaaatcactccattacttttgtagctataaataaagtggagctgaacgaagtgaagccccactcattttgatgaacctttattaaaggttcatgataatgcataagttctcccttccataaaactccccttagttattgctccaattccataaacccactctattttctttagcttccctctcaacatttaagaattcatcctttaactcaaaattacttatataaacccttgcatatccatactttaaaagctcttcattgaagtttattaaattattactattatttataaagatgtatgctaaatatctcccatatttatctttctttggggcttcattatcaaagacaattataactgttttatttttaagttctttttctgcaaaatgcttagctttatagccccattcttttaagtattttgtatctgttatcggtgttccatttaataaataatattcatacgggttgtttctcttgtgaatttctggagtatctacccctaaaagcctaatcttccataattccccattaacttcaacataaacagtgtctccatctacaaccttaacaacctttccgtagtagtgttcatgagtatctacaaaagaagtgtaattattataactccaactatcatgataataaccgttagaattagaggatgagaaatcaacacagccacatagagttgtgaagattaacatagatagtattaggaattttctcataatcctccctctaatcattttaacctaataaatatatactaaatactttaatacttgctataattgataataaaacaacaactcttgttatttcatttgaagctcctaaaacatctccattaactcctccaaaatgtcttttggctattttagccatacataagccagtaattattgtcgttattatggcaataataactatcttcctttcaatcccactgaatattaaaagtaatgggagagataaaataataccaattgttaaaaatttttcatctgcctttttaacaaagtatctcccagttccttcaattaaaggatttccaaaggttgaacagcttagcattccaagctttgcacaaacctctccaaccaatagatataggatattaatgtctaaaatataagataatgatatgactgccattaaattaaaaaatattgcaaaaactactcctccacagccaatatatctatctttcatagccattaatttctttctcttatctccaacagccatccacccatctccaaagtcaattaaaccatctatatggtggaatccgtttaaatattcaataaaaaacaaaattaaaacagcagataaaaaattggggagcaaaaaactaaaaatataacctaatatcaaactaaaaattccaaacacatatccaattaaaataatcagataaaaatagttggcaatgttttcaaaatcaaaatcttctacatagattggaatccttgtaaaaaatgacaacagtgctttaaattccttaaacattgttatccccaaaaaattttatattttaatccttttttaaatttttaacaatatctacaagctcttgaagggagtttattgtgtaatcgctatattcatcatcttccatgtctttatatttgcccttcaatatcctaactgttatcatccccaactctttagctggttttatatccttatcaaccctatctccaacatatactgtttcttctgcttttaaacccattctctttaatccatatttaaaaaactctaagtgaggctttcctaaaccaaattcctctgaggttataacatcatcaaagaatggatgaattcctaatctaataagcttttcccattgctttatagttaatccatcagttataacccccaactttaatcccattgccttaagttccattaatgtctttattgtgtgtggataaggccttaataatgctactttaacgttatggtaggttattattccagtagttattatttttgggtcatattttcctaaaacagctttaactaaatcatcaaaatgctttccataatttgaacctttgtccttaatgattttgtttaatatgttcattgcttcttcaaaatctatatttaaaccagcatctatcattgatttaactgcttctcttcttgcaatctctacaaattctgatgaattatataaggtatcgtctaaatcaaacaaaattccctttatcatattttattcccttttagcattttttaccttctctttgaccatttgaaacaatccaacaaagtcatcatcctcattaacaggaacaacaattaatcctaactttttatgcctctctatccaaccttcattataagcaggaacttctatctttatcggttcatctgttggattcccaactataacatttctgtatgggaagggctttacttcatcatcctcttcataaggaaaggtagtttctctaatatatcctcctaaagccattgtcattcttggtaataaaaccatctttggcatataatatcccccttaatctacttgcaaaaaataatataataacctcccaaaatttaaacttaactaaaatagtttatatttatttttataaatttatacataataaataaaagagaaaaaaagaatggggaagttagtatttagtattctatgtagtcaatagcatgtttaaatactaataagttcctgtctccaacttttaccattatttcataattagagactcctgtaacttcagcatctaaaacttccccatttcttaagaatatcttgaccttcttcccatttaatcttcttgcatattcaaagtttgggatgactttctttggttgctgtttttttactggcttattcatctactcccaccttttgacatcttataaatatcaacccttataattttcaatcacatatatatacttttttaaagatagcaaaaaattactttgagaggcagaattctttaattggacagttatcacataatgcctttttcctacagaactttttacagtgctctactattaatgcgtgatattctttgtatatttctaaatcttttggtaaatttttttcaaatatttccttaatctcatcatatttagctttttcgttaattactcccaacctactaaacattcttttggtataggcatcaacaacaaagctctccctatctaatgcatacaacaaaatactatcagctgtttcctttcccactccatttattgataagagctcagcccttaatattaaagtgtctttatctgtcttagccatctcttctgtatttccataattttcaacaataaatttagttacattttttagacgcttagcttttaaattataaaatccagctggccttataagttcttttagtttatcttcatcaacatttagtatttttacttcttccaacaaatcttccatctttagattatttatagccctctctacatttttccaacttgtattttgagttaaaattgctccaacgacaacctcataccttgtttcggcaggccaccaattttgatgtccataataatctaataaaattttgtatattttgtatatcatctcaaatttgttctctttcatttatcatcctcctctataataatggacttattatcaaatggatttgcccttaaacataatgaatacagatatggatagttatcttttaagtgcattaggtagtttagccattgaataatcaataatttataaactctaataatatcgttttttaaatggtctaaatcactttttggaaggttgcttaaatcctctcttctatgtagctcatcagctaaatgaaatactgccaatagtaattcggtaaagctttcatgctccaatagcaaaggattttccatcaatcttaaaagaaattctttatttctctctaatagatttttaagcttatataaatcaattttttctatatctatgttacaatcataattcattaataatttttttgtttcttcgtaagttttatcattccattcatctgatatttttaagtaatcccttatattcccaacatctccttctaagattatttttaaaagttcctctccaacactattaaaaaaagaaccaacgaccatatttaatttttccaatatcttctttttttccctataatctaaaattttctcaatgattaaacttacaagcaaaacttcaataggaacaaatgccaaatgtaataaaaaatagcttaatatgtaatcaacttttccaaagattaaaaaatgtattgaataaaccaatatagataaaaaaattaaacaaatagctattattaacatataccttttatcattcatttttatcccttaaaattccagattttgtctcctacatagtgaaggtttttaatagcttttcctttatctgcttctttcatctcttttccattcattaatgcaattccaacacatattggctttttgtggttttcatctaccacaaaaacaacatcctcctctttaatattttcatctgcatctacaattcctggagccattacatctgctccatttattaaaaattttatagcacctatatcaacaacaactaaatttttatctgggagggattttaataacaattttaatgttggaattactttatcatcttttttaaatgcaattggctctttatcgactaatattatctcaaagtcatcagttatagctatctccacatttcctttttttgggattatctcatcaacattttcaaaaaacacttccaattctttttttatttttttaacatcttttttacttaaaaaatatcttttccttatttccaacctctcaccttttataataaattactctaaaattttatacaaagtagttctctccttaggaattaatccaacccttttaatcatgtctctaatctcttcaacactcatataaactccatgctcagctcctgcacttcttgatatactctcctctatcaaagtgccaccaacatcgttagccccacatcttaaagcaacttgaaccatcttttttcctaatttaacccatgaagcttggatattttttatcaaacccttaaatattattctgctaacagcaaaaacctttaaatcttcaattccagtagctccagcttttgcctttccttctttatagattggagcatatttatgcataaatgagagtggaacaaattcagtaaagccgttagtctcttcctgaatctctttaattataaaaagatgatttacccagtgtttatattcttcgatatgcccatacatcattgttgcagttgttggaatgcctaatttatgagcctccttaattatataaatccactctttagtttttattttatttgggcagagttcagctctaatgtcatcatctaaaatctccgccgcagttcctggcatggagttgagaccattttctttcaatattttcaatgcttctttaatatctaagccagcattctcagcaccaaaataaacctccattggagaaaaggcatgtatgtggatatctccgtaaggttttgttgcttcatgcacagcctttaaaatctccgcctgataatatgtatctatctttggatgcaatcctccctgaatacaaacctcagtgcaaccaaatttttttgcttctactgccctcttagcaatctcatctatatctaaaaaataagcatgtttgtcattttcattggctctgaaagcacaaaatctgcaatttccaacgcatatatttgtgaagtttatatttctatttaccacgtaggtaactatatctccaacttcctctcttctcaaagaatctgcaaatttaaacaactcaaatataatctcattatcttcaaataactctaatgcttcttttttggatatttctttctctctaaatttatttgggtccatattctcatctcttagagtagtattctccagttatttttagttctccatcttctattttataatggaaacatgaataataaccctcatgacatgcaacccctttctgttcaactataaataataaagcgtctccatcacagtccctataaaattttattaatttttgaacatttccactctcttctccttttctccataacttttttctacttgttgaataataatgcatatatccagtttctaatgtcttttttaatgcctcttcattcataaatgcaaccattaacacatttttattctcatcacaggttattgctaaaattaatctctctccttctatatttctgaattttaaatttagttttttaacagtatcttccacatccatgaaatcacctaaatatggatattaattaggactgaaagtcctaacttaatagacgggtggtataccaataggaggtttcctcctatggttaccaatcatctaaacccatccattctccgactatgtttatatcctttcctccatatactccatcaaatttgtcaattttgactattgatgggagggatattgctgctcctacaattactgcttctccaatacccaaagatgccaaatcttttaccaaatcttctccaagttcttctgaagctctctgtatatatttttggtcttctggttcgactatttttaaaattatcttagtgttcgtttgagataaaacatcaggatgcaattgcttaggtctttgggatactaaacctaaaccaacaccaaattttcttccctctcttgctatcttccccaaccataagcttgctgagttttgttcatttactggaataaatatatgagcttcttctacaattaacaggacaggttttgttacaactttgtagtgtgattcaataatgtttaagtttgattgtgcaactcttctaatttcctcattaatactatatacatcctttaatgattttaagtaagttatcctttttaaaagaagatgtttagctataaatcccacaaaagtaaccatctgaggaatctccaacccacttaaattaacgatgtttatttttccaatttcaaattcttcaattacatctctatccccaatatttaatgcataatctaatttgaatttgctaatagtatcaatgagagacatcaatataacgaaatcttccttttctaattttcttctatcatagttccttcttaatgggttgtaatatttaatttcccatccaactgatgctatcttactccattcatagagtagattttctattttttcaataaactcaattcctttagcatctggacattcatgttttacagtgtggtatgcaaattccacataaactctcttctctatctcattatcgcctatcccaattaaattagcaaattcacttggagctaataaaacagggtttattattggatttattacctttattttcccctccatgtcttcatgatataaagagatatactctccatgggggtctatcattattacagttccatttttctttgcaagttctctgcacaaaacagatgcggtatttgattttccccctccagttatagagagtattgcaaaatgtcttgatacaagtttatttgtgtctaaataaactctaacattatctcttgttaataaatgacctatattcaacccatctggagttagatatatattatttaggatttcatcatcacacaatctaacttcactgtttgggagtattggtgttctattgggaattattttgtttccatccaatacaccaatgactttaacttcaccaacaaatttctcaacatctgcaactacattttttataacacccaatacatctctgccatcaacattttttgcaattacatactctccaaatcttatcttttcaagggattcaaaagtaaagtgtgttgttgtagtctttcctacaaccttcataacatacacccaagtttttggagaagctcttttatttgcattaaaacgctctcatcagatttataatcatcaattaattcacagtatctgtacatctctaatgataacttggactttatatcattgaccatttgggatatttcatctaagcttatgtatgattcaataaatgatagatagatatatgctccaataggattattatttgccatatacttccataggtttgatgcatagaaacaagtaatatttggtttgtgatacattacaggaatatcaaataaaaccgaaggtatttcaagatttgtaggttttctacttcttaatttttctaatatattgtcgatttcacatgtaaattgcaaagaattgacaattttcaaaatttttgtgtatgttgttatcgcttcatcgatttttccagatttttcaagaactattgcaagagattttaatgtgctaatatcttttggattcactcttaaagcattcataaaagattcatacgcatccttgtagttccctaacttgtaataaatataccctttgacataccaccatctactgctgttttccagatttattaaattatctacatatttcatagcctcatgatagtattttgggattcctgttgtctcagcttttccaattagggagtataagttgagtgcgctaatatcttcctctgagagttcttcaaggtatgtttctaagactttatcaaaaaagtttgaggatttttccaactctccttttctgtaataaagtatggccaatccaaaatatgcatatggattttgtgaatttagcttaattgccttgttatatgcttctatagctccctcttcatctccaagcttgtataatatatctcctttttttgcataatataaactcctattaaatattgatatcgatttatcaatatattcaagggcttttttatattcttcaaagatttctgcaattacacttttataatagtaagagatgtcagaattttcatctatctgaagcactttattaaaaatttttaatgcaccaatgtaatctttattttttatcatcgtaagtccattatttaaatcttcataagagtttatggcatttacaacgttttccatacattcaacaatttttttacactcatggcttggattttgttgtaatatttcattaaacgcatcatatgctttatcaatgtctccaaacagtagataaatctttcctgccttaaataacgcattgagattttttgaatttgccattttatatgattttaaatagtattttaaagcctcttcgtatctaccatatttaaccgaaatatctcccaaaatttcaaataattcctcatttttaattttttcagaggcctttttaagatatttatatgctaaaattatttccccacgtttatagtgaatgagtcctttaagatatgcaaaatatatgtttgatggagatatttttaacgcctcatttattgcctcaagtgcagagtcgtatttttctaaatggtagagtgcataagcaagattaaaccaatcaataggattggtatttttcttttctaatgcttttaagtagcattcaactgctttgtcatatattccttcatctaagtaatagttagcctcagtaacccaatcttcataggatttaagtttttcacttatctttctgaacaagttcattgtgaatcaccaaattttatgccccacattatttgctttagttataattatttctccataaactccatatttatcaaaaatatcgttggctttttcaacaattaattttttgtctccaaatgcataaattgttgggccaaagcttgaaagtcctgcataaacatctttatgcaattcattaattaaatctttaacaatatctgattgtaaagagagttcaacttttttaaagcctaagtattgaagcttgttgataacttctccaaaatcatctaaatttttttcaacaactgctggcatcatcttcattaaaactaaatggcagattttttcaacttcatttaaaggaactgggcagtattttttaaatatatccacttctttttttccatagacatgttctccttttggaattattaagatagtttcccaatcaaaatcatgtctaaatattattggtgctggcttaactccttttgaagcagatgaaggtctaaaatcttctttatccttacccttgccaaaactatgccctccatcaattaaaaatcctccatactcaaaagcccctattccaatgcctgaagtccctccccttccagtaattttagcaatattgtaggcgttcatttctttattgtatatttttgatattaatttacctacagccaaagatagctgtgttccactaccaagaccagaatgggctggaaatagtgataggatttttaaatcaactccctctccaccaataacatctaaaactttgatagctgtattatatactctatctctaacagattttatataatcttctccatacttttcaatcaattttttatcaaactcaatggatatatcatcactttcttttccttcaatttttatatttggctcctctaaagccaaaccaatacctccatcaactcttccaatagaaccattcaaatctataagccccatgtgaatccttgatggtgtttgaattatcaaaatctcaccattattaaggttttaaagataataacaataacaaccagatgttctataaattataaatatttacaacaaaaaataaaaagtttgaagcttaaattaatgcctctatcaaatcccctcttgtaacaataccaattaaatttccttcatcatcaactactggcaatcttttgatgttatttttaaccatcaactttgctgcatcattaattgtcatatctggcttagcaacaataacttttcttgtcatcacatccctaacctttgtttttaatgcattttttaaatcttccataaattcctctatctttaaagctgtttttagtggaagttcaatcaaatccaatggtgatggtaaaatgagatttaaatcttcattatgtgtaacaatggttttcactatgtcactctctgagattattcccactaacttaccatctttatttaatactggggctccacttatcttatttttcctaaataatcttattacatcgattaaatcattatcctcataaaccacaatgggttttttcatgatatcttttattaacattatttcaccatttatatttaatttattcaatatagtcctcaatatttaatcccaactcattacaaatttcttttaattggttgtataagtttttatcaatttcaaatccatcctttcttttcattttattcctctcctctatttccccagggattaatatctcaaaaccttctgctggctctgagtttttaatttcatctaacaactcatcaacttttcttttaaactcctccttccccataaaaaattctggatttatagctataaataaatctcccttagtgcatctctcctctggattagcagtccctttaaccttagtcccaacctcagccccaccgatagctgacagcatttcgatagctaatgccaaaccataccccttaggtcctccaaatggtaatatacatccttccaatgctttagcagggtctgttgttggctttccatctttatctactgcacaaccttctggaatctttattttttttcttaaagcttctaaaatctttcctcttgcaattgaagcagtagccatgtctaaggaaaatttatacttatttcctttaaatgctatagcaattggatttgttcctaaaattttctctttaccaccaaaaggagccatagctggctctgtgtttgttattgttattccaatcatatcttgattcatagctaactctgaataatagccagcgataccaaagtgattagcatttcttgtagcaacaactccaactccaacattttttgccttttttatagctaattccatggctttttttccaacaacttgacctaaacccaaatctccatctataactgccgttgctgggctttctttaactatctttatatctggctttggatttatatttcctaattttaaggcagttatatactgtggaaaccttccaattccatgagaagtaaaaccctttaaatcagcatcaacaaaaacatcggcagttattttggcatcttcctctggaacaccaaatttttttaagacatcaattattaactttttttcattttctggttttaaaatcattatatccctccaaaaatttttaattttatggttttacataggtcatgttataatagacaatatccccatctgcatcaacgattgctatgagtaatttttttctaactgagtgagcaaccctaacaaacccagttagctcacttaatagaaaagagctatcttcaggaaataccttaaccaaataaacagagtgttctttatctatgttagctcccctctcataaagcctaaaatcagccccatacttcaaaccagtctttactatataacctcttgttcttaaatccttataaactaaatattttaaacatagtctttcttcaacatttctcgcatattcatatagttcttcaaaacttagaggtttgttatctttatatttcacttccaaccatcctaaatttatcaaatagagggcttcaactaaagatagagataaaaaattcccttcaacatttccataatgccttgctgataacttagatatcccatttttgtcaaacactataactctatctccatccaacaatccagttatttttttgcccattttatctctcaccaaagttattatttataaaatcttaaaatttattgtggataataaaataaataacatatggtttatgttatttaacaaaattaatgaatgaattaatatagaacttcgcagtttttatattaaaaaggtatttagatgcctaaaggcatcattattcaataaatcatttattcctgcgaaagttctataatattgaggtgaatctatgatattccatccaagaccttcaccaatagctgctgcaatgtatcaacttagggatttgggtgttgatgctataattttacatggtccaagtggttgttgtttcagaaccgcaagattattagagttagatggagttagagtatttacaagcaatattgatgaaaatgctattgtctttggagcttcagagaatttaaaaaaagctttggactatgcaattgaatatttaaaaaaagagttaaagaaagagaggccaatgataggcatagttgggacgtgtgcaagtatgattattggtgaagatttgtgggaatttgtagatgatgatagagccataattatcccagttgaggtgcatagtggaagcggtgataatacaataggggcaataaaggctatggagtcagctttaaaattaggaataattgatgagaaagagtttgagagacagaagtttttattaaaaaaagctactgaagttgagaaaaaaagaggcatggcaaagaaagagtatataaagccaacttatgatgatgatttaaatgaagctataaaagttttaaaggatttgaaagaaaaagatgggaaaatagcatgtgtgttgaatgctaaaaaagaaactgcctatttgtttgctcatcctctaattgttttaaataagtactttaactgtgtaaatatagcaaacttagatataaataagggacttccaaagataagaagagatgcacaaaatatattaagaaggtttaaagcagattatattactggtgggttagatgagtatccaataaccggagagagagcagtcgaaatattaaaagatttggatgttgatgctattgttgtctctggtgttcctcatgctttaccaattgaagagatagataaagacataataaagataggcataagtgatggaccaagaacatatcatccaataaaagaaatttatgattacgcaattgttgaattagatgcacatgcgaaggttttagggaaaagagatattgtaaaatcaagatttggagaaatattggattatgcattggaataaagtttaaaaattattaatccataaaaaattttggtgataataatggaaaaaccatgggtagagaagtatagaccaaaaacattggatgatattgttggacaggatgaaatagtaaagagattaaagaaatatgtcgaaaaaaagagcatgccgcatttattatttagcggacctccaggagttggaaagtgcttaacaggagatacaaaagttattgtaaatggagagattagagaaattggagaagttattgaagagataagcaatggaaaatttggagtaactttaaccaacaacttaaaagttttaggaattgatgaagatggaaaaattagagagtttgatgtgcagtatgtctataaggataaaaccaacacgttgataaaaataaaaaccaaaatgggtagggagctaaaagtaacaacttaccatccacttttaataaaccacaaaaatggagaaataaaatgggagaaagcagagaatttaaaggttggagataaattagcaacaccaagatacattttatttaatgaaagtgattataatgaggaattagcagaatggcttgggtatttcataggagatgggcatgcagacaaagaatcaaataaaataaccttcacaaacggtgatgaaaaacttagaaagaggtttgcagaacttactgaaaagttgtttaaggatgcaaaaataaaagagagaatacacaaagacagaacaccagatatttatgttaattcaaaagaagctgttgaatttattgacaagcttggtttaagaggaaagaaagcagataaagttagaattccaaaagaaataatgagaagtgatgcattaagggcatttttaagagcatactttgattgtgatggtggtattgaaaaacactcaatagttttatcaactgcaagtaaagaaatggcagaggatttagtttatgccttattaaggtttggaataattgcaaaattgagggaaaaagtaaataaaaacaataacaaagtatattaccatattgttatctcaaactcttcaaacttaaggacattcttggacaacattggatttagtcaagaaagaaaacttaaaaagctcttagaaatcataaaagatgaaaatccaaacttagatgttataactatcgacaaagagaaaataagatacataagagatagattaaaggttaaattaacaagagacattgaaaaagataattggagttacaacaagtgcagaaaaatcactcaagaacttttaaaagaaatatactacagattagaagagttaaaagaaattgaaaaagcattagaagaaaatatattaatcgattgggatgaagttgcagaaagaagaaaagaaattgcagaaaaaactggaataagaagtgataggattttagaatatataagaggtaaaagaaaaccaagtttaaagaactatataaaaattgccaatacccttggtaaaaatattgaaaaaatcattgatgcaatgagaatctttgctaaaaagtattcaagctatgcagagattggaaaaatgctcaatatgtggaattcaagtataaaaatttacttagagagcaatacccaagaaattgaaaaacttgaagaaattagaaaaactgaacttaaacttgtaaaagagattcttaacgatgaaaaattgatagatagcattggctatgtattattcttagcatctaacgaaatttattgggacgaaattgttgaaattgagcaattaaatggtgaattcacaatctatgacttacacgttccaagataccacaactttattggtgggaatttaccaactatactgcacaatacaaccgccgctttatgtttagcaagagatttatttggagaaaactggagagataactttttagagttaaatgcctctgtttcaaaagatacaccaatattggttaaaatagatggaaaggtaaagagaacaacctttgaagaacttgataagatatactttgaaactaacgatgaaaatgagatgtataagaaagttgataacttagaggttttaactgtagatgaaaactttagagttagatggagaaaggtttctacaataattaggcataaagttgataagattttgagaattaagtttgaaggaggatatatagagctaactggaaaccactcaattatgatgcttgatgaaaatggtttagtggcaaagaaagcaagtgatataaaggttggggattgtttcttaagctttgtagccaatattgaaggtgaaaaagataggttggatttaaaagagtttgaaccaaaggatattacttcaagggttaagataattaatgactttgacattgatgaagacactgcatggatgcttggattgtatgttgctgaaggagctgtaggctttaaggggaaaacatctggacaagttatttatacattaggtagccatgagcatgatttaattaataaattaaatgatattgttgataaaaaaggatttagcaaatatgaaaacttcactggctctggatttgatagaaaaaggttatctgcaaagcagattagaatattaaatacccaacttgcgagatttgttgaggaaaacttctatgatggtaatggaagaagagcaagaaataaaagaattccagatattatatttgaattaaaagaaaatctaagagttgaattcttaaaaggattggctgatggagatagtagtggaaattggagagaagttgttagaatatcatccaaatcagataatttattaatcgatacggtatggcttgcaagaatatctggcattgaaagttcaatatttgaaaatgaagcaagattgatttggaaaggaggaatgaagtggaagaaaagcaacttactaccggctgagccaataatcaaaatgattaaaaagttagagaataagataaatggaaactggagatatatattaagacatcaactctatgaaggtaaaaagagagtttcaaaagataaaattaagcaaattttagaaatggtcaatgttgagaaattatcagataaagaaaaagaagtttatgatttattgaaaaagttatctaaaacagagttatatgcgttggttgttaaagagattgaaattattgactacaacgactttgtttatgatgtatcagttccaaacaatgagatgttctttgctggaaatgtgccaatattattgcataattctgatgaaagagggatagatgtaattagaacaaaagtaaaagattttgcaagaacaaagccaattggggatgttccatttaagattatattcttagatgagagcgatgcattaactgcagatgcacagaacgctttaagaagaacaatggagaaatattcagatgtttgtagatttatcttgagctgtctaactggagatgcaaaaataactcttccagatgagagagagataaagatagaggactttataaaaatgtttgaagaaagaaagcttaaacatgttttaaatagaaatggagaggatttagttttagcaggggttaaatttaactcaaagatagttaatcataaggtttatagattagttttagaaagtggtagggagatagaggcaacaggagaccacaagtttttaacaagagatggatggaaggaagtttatgagctaaaagaggatgatgaagtattggtttatccagcattggaaggagttgggtttgaagttgatgaaagaaggataattggcttaaatgagttctacgaatttttaacaaactatgagattaaacttggatataaaccattaggtaaagcaaaaagctataaggaattaataacaagagataaggagaaaatattaagtagagttttggagctctcagataaatacagtaaatcagagattagaagaaagattgaggaagaatttggaataaaaatatcactaacaactataaaaaatcttataaatggaaaaattgatggatttgctttaaaatacgttaggaaaattaaggaacttggatgggatgagataacttatgatgatgaaaaagcaggaatctttgcaaggttgctgggctttataattggagacgggcatttatcaaaatcaaaagaaggaagaatattgataactgctacaataaatgaacttgaaggaattaagaaagatttagaaaaattaggcataaaagcatcaaacataattgaaaaagatattgaacataaattggatggtagagaaattaaaggcaaaacatcatttatatatataaataacaaggcattttatttattgctaaacttctggggagttgaaattggaaataaaaccataaacggatataacattccaaaatggataaaatacggaaataaatttgtcaagagagagtttttgagaggtttatttggagctgatggaactaaaccgtatatcaaaaaatacaacataaatggaattaaattagggataagagtcgaaaacataagtaaagataagacattagagttctttgaggaagttaaaaagatgttagaagagtttgaagttgaatcatatattaaagtcagtaaaattgataacaaaaacttaactgagttgatagtgaaagcaaataataaaaactatctaaaatatctatcaagaatatcctatgcctatgaaaaagacaactttgcaaggttagttggagagtatctaagaatcaaggaggcatataaggatataatcctaaaagagattgctgaaaatgcattgaaagaagcagatggtgaaaaatctctaagagaattggcaaggaaatataatgttccagttgattttataataaatcaacttaaaggaaaagacattggattaccaagaaactttatgacctttgaagagttcttaaaagaaaaggttgttgatggaaagtatgtttcagaaagaatcattaagaaagagtgtattggttatagagatgtctatgatataacctgccataaagacccttcatttatagcaaatggatttgtgtctcataactgcaactatccaagcaagatcattcctccaattcaatcaagatgtgctgtctttaggttttctccattaaagaaagaggatattgccaaaaaattaaaagagattgctgagaaagaaggtttgaatttaactgaaagtggtttagaggcaataatttatgtctctgagggagatatgagaaaggcaataaatgttttacagacagcggcagctttgagtgatgttatagatgatgagattgtttataaggtctcatcaagagcaagacctgaggaagttaagaagatgatggaattggctttagatggaaagttcatggaggcaagagatttattgtataagcttatggttgagtggggaatgagtggggaggatatattaaaccagatgtttagagagataaacagtttggatattgatgagaggaagaaggttgagttggcagatgctattggtgaaactgactttagaatagttgagggagctaatgaacgaattcaattgagtgctttattagcaaaaatggcgttaatgggaagataatttaaccttctttttcatgaataattttattatttccataaanatagacgttgaaaatgccctcaccaaacaaataanccantcttttaaatttaaagagtaattttttcttttctttaagttccttgtatccatatatttttaatctttcttcaacttcaagatttgataagccaatcatcaatatcactgcaaaaaatgtatatggcaatgtttataattcacaacgtataaaccttttttaacatcctatcatattatgaaaaggttattttacacataaaaagtaggagatgattatgaaaagagttgtgattgccggaacatcaagtgaagttggaaagacagttatctctactggaattatgaaggcattatcaaaaaaatataacgttcaaggctataaagttgggcctgactatatagacccaacatatcacacgatagccactggaaataaatcaaggaatttagattctttttttatgaataaagaacaaataaaatatctttttcaaaaacattcaaaagataaggatataagtgttattgagggagttagagggctttatgagggaatatctgcaatagatgatattggaagcacagcaagcgttgccaaggctttagatagccctataatcctgcttgtgaatgcaaagagcttaacaagaagtgcaatagcaataataaaaggttttatgagttttgataatgtgaaaattaaaggagttattttcaattttgttagaagtgaaaaccacataaaaaaattaaaagatgcaatgagttattatcttccagatattgaaataattggctttatcccaaggaatgaagattttaaagttgaaggaaggcatcttggtttagtccctactccagaaaacttaaaggagatagagagtaagatagtgttatggggggagttggttgaaaaatatttggatttagataagattgtggagatagctgatgaggattttgaagaggttgatgatgtgtttttatgggaggttaatgaaaattacaaaaaaatagctgttgcctatgataaggcatttaatttttattattgggataactttgaagctttaaaagaaaataaagctaagatagaatttttcagcccattaaaagatagtgaagttccagatgcagatattttgtatataggaggaggttatccagagctgtttaaagaagaattaagcagaaataaagagatgattgaaagcattaaagagtttgacggctatatctatggagaatgtgggggcttgatgtatataacaaaatcgattgataatgttccaatggttggtttattaaactgctcagctgttatgacaaagcacgttcaaggacttagctatgttaaagctgagtttttagaggattgtttaattggaagaaagggattaaagtttaaagggcatgagttccattactcaaagcttgtcaatataaaagaggagagatttgcctataaaatagaaagggggagaggaattatcaataacttagatgggatttttaatggtaaagttttggctggttatttacacaatcatgctgtagctaatccttattttgcttcatctatggttaattttggtgagtaaatagaagataagaatgaaagaaaaatctcatatgagattcctgaaaaaatttccatttttgattttagaaattatttcatggatttttgagttattttcatttgtattgattatttttggattttctctatctttaggatttggaaaggagatattgttgataaaaaaataataaaatatgaggctcatgatagaagttataaaggagaaaatcgtagagaggaagctttttaaaaggaataggaatcgatagaggttaaaatcttagcagggcttttatactacctcggattatcgttaaggaaggtaagtttattcctctcccaattcgaagacataagtcacgaatcgattagaatttattatcacaagattaaagaggttttaaatagatttccaagtaatggtaaattcgatacggttgttagttgagtaaaaagcttcataatgttctataactggatgaaatcgctaacttaacaacctcataaggatttcacagtttatatattaactttggagcttaagtactaagaataagaaagggttataaaaattcattcaataaaattctaaaaacttattcaacagtaacgctcttagctaaacctcttggtttatcaacatctcttcccaattcaactgccttataataagctaacaactggaaggctggagcataaacaattggagaaatctcttcaattacctctggaactaatatattttcagctccatctatttcagttggagttatggctataacttttccccctcttgctttaacctcttctatatttgataatattgagttaaatactgcagaatcccttggaggaactattgctacagtatccatattttcatcaattagggagatagttccatgctttaacagtcccccactcatcccctcagcatgtaaataagttatttctttaaattttaaggctccttccaatgcacttgcaatatttattcctttagagatgaatatgtagttatttacttttagattgttggctatttctttaattgtttcttttttatctaaaacctcctttatataattcggaattttatcaatctctttctcatattcactcatatctctacctaaaagctttccatattcaataaacaacctatacagtatcattaactgggatgtgtaagttttagtagcacagacagctatctctatccctgctcccatcataacggttatatccgcctctcttgtagctgtgcttcccaaaacattaactatagctccagtttttgccttatttttcttagcaaatctcaatgcctttaaagtatcgtaggtttctccactttgtgtaatccctataactaaggttttatcatcaacaacccctttatttaaaaattcagatgcatcacaagctataaccagctttccaagctttgcaaacaaatactctacaaccattgccgcatgtaaggaggttcccatggctacaaaataaaccctatcataatcttttatacattttgccaattctttaatttcttcagcggatattttggcagagacttttaaaacctctggctgttccataatttcttttagcatgaagtgaggataacccatcttttcagcagaacttatatcccaattgatttccatcatctctctttcaacagtatttccattattttctatagttacttcatatccattttctttctttttaattacaacaacatctccatcctctaatggaattgctttatttgtgtaatctaaaaaggcagttatatcactccctaaaaaatagccgtcatcattaattcccaatattaggggactttcatttcttgccccaattaataggtttgggaaatttttatttattataactaatgcataagttccttttaattttttaattgcatttttaacggcttttatgtaattttcttcattaatttctttaaatttttttaattcttcttcaattaagtgagggacaacttcagtatcagtttctgatttaaatttatgccccttcttcattaattcatcttttaactctttgtagttagagatgattccattatgaactactgcaatctcttctttgcagtcagtatggggatgagcgttttctttgcatacatttccgtgtgttgcccatcttgaattatgattaattattaaattcccaatgaaattatgatagtcctcaacctctaaatcatagacatattcaacatcagattcaacctcttcaattttaaattttgtccaaactatatcagcgtctaaaaatctttttaaatactctgctttatcatatagtcctttactgtttagttcttcaataatcttttctattgtgtaatcggtgcaatagttatctccattttttattgtttttaatggaactcctacaaattccctaatctcttttttagttaaaggaattgaaatatatctaaagttaagtcctttcattttgtttaatatagcctctaatttctccattttgtcctttgcagtaaaaccaatgtattttttaaataattcaaaggattttttatcacttataagaagcttatgagtattgttccaattttcctcttttcttttaatttttgaatatgatgctaaaattccaaatctcaacaacaagaactgaatctcttttataaagcatttggaagtcattcctataccaatttgcttagcctcagctcttatataaccttctgcatcaaatattcctcttaaatatgatgcaaccaaatcattatttaatctaaatacaaattctggagttctctcattaccggttttattaaataactctggaatgttttctctgaaccaatcaatcaggtatttgctgtttatctctaatatataataattgccatctccttttttgatattcccttctaagttaaagacagttttaaatagttgattatattcctctaaaacttcttttctttcatccttcaatctcaacatcctatttgaagggaaatgcccatctccaataatataaccaataatctgcattaattctggagtaggagtttttggaaatttaacaggatttgtgtaatgtaagttatccctatatataatctcttcaaagttgataccataaagagaacataatttctttaatctctcttcttcaatactctctaattttccagtttcaatttttacaatatatatttctttaactccacataatttttcaacgtcttttcttgttagtcctaatttttctctaacttttcttagtttatttcttattgtttcatctaacttataatgcctttcaacatatacatccttaaactcaacattatcattaaagctataatttaacttcctcactacaccaattaactcacttccattcaaatctttaacacacttctcaactatctttccattctctacaacaaacaatttatgttctccagttgtaataagttcagaaaaggcagtttttatcttatataatatctttggtgctttatgtttaaactttttgatttttttattatatagctttaaatcttcaaaattaactgataaaacctcatcttcatcaatttcagaaatctttttcattcttccatctggcaatataacataagtatctggatgcaaacaatgccctatcccaatatttccatcaatatccaaaaatctctcttttttagcaacctcttcaactttgcccacattctttttaataattagtttattattatcaacaactccaattccacagctatcatatcctctatattccaaccttcttaatccatttaataagatttttggagctttatcattacctatatagccaatgataccacacataaatttcaccgataaacctaaatatctcctaaagtaataaatagttaaaacccataaacaataatattaatactaattttaaataattctcttttaaatatattatataatgctttgtttggaggtgagagttatggtatttggtagtgcagcgagtgagaaaacacctgaggaaatattaaaaggagttgctttgatgttggatgagataattaacgatacaaccgttccaagaaacattagagctgctgctgaaaaggctaaagaagctgttttaaaagagggggaggagccaatcgttagaagtgcaacagcaatccacatcttagatgagattagcaacgacccaaacatgccacttcacacaagaacacaaatttggagtattgttagtgaattagaaagagttaaataaatttaaaaatccccactatttctttacaagaaggtttaaaagtgtaagtttagcttgttcttctaaaacctccacttttatatatgcatctatcaaatctttacctaaacaaactactccatgattttttaatataataacgtcctcatctctttttgctgtttcttcagctaattttaaactacctgcctcatagtaatcaacataaccaattttcttcaaaaatatttttccttctggtgttaaaagttctatttctttgtttattgtcgataaaaaagttgatataagtgaatgagtgtggattattgcgtttatgtcatttctttttctataaatcattaagtggagatttttttctgatgtaggttttccttttataacattaccatccaaatccatttcagctatatcatcttcctttaaaaaccctaaaatagagccagttggagtcagatatattttatccccctctttaactgatacattgcctccactacctacaacatatttcctatcatacaattttctacatattttaataaattgctttttgtccataatctcacttaaaatatttttattagtttcaacatcaagattataaccgttatataaagaaatacaattaaaatccctaagattatgatattaatgcggattatttttaggtttctttttaaatcctccatggtttttatgtatattcctaaagctaacaacgcctcttgttttaatattttattagttttttcatctaattttttctcattttcttttagttttgcatctactctcttctctaattctaaaatttttttactcaatacttcaaacctctcctctatttccttttcatccatagtagcccttatttaaatattaagttaataattagataatagtgattttaaatattgaatagctatttgtatataattaaaaagctgggtagataaatattcattatttaatattaccatatagctaattgtaagacctattgcaattattactatgagtaatagcatagatatttgttttaattttctttccattctatttttatgttctatgtcttctttaacatatttctccatttcttttaaaatttcattattattttcaagatatttatcaattttttgatttagctcttttaacatatttacattttgcctcataaattcgtttaattgaacattggaagagttgatatttttatctttaatctcatcaagttgctcatataatttctttatttcatctaatattttattagttaaatctttctgccccccccctattatccaaatcaaatacaagaggaactatctcatccaaggtttttacaggaataatctctattccctctgtttcaataacatctatcatgtttgcctctggaataataaccctcttaaacccgtatctcttagctgcctctatcttctcattaactcctccaatagctaaaacattcccacttaaatctaagcttccagttattgcaaagtcctgttttaatggaatgtctaataaagcagatattatagctaaacaaactgcagctgtagcactatccccatcaatctttgaatatgactgactgaattggatatatatctctttattatttaagtcaatatctttcttaggtagaggaagtttcttctcagctactaatttttttgacaatgctgaagctaaagttattgaatgctttgcaatatctccagaaatatttaatagatgagttcctgggttttttgattctaatatttgaacaataatctttgttacatcccctattcctccagctcctaatacagctaagccgtatataactccaacctttggttcatcatttggcacaatatgcttgtatctcttgaagtttttgatgtagtttaatgccacctgtttttccatactgtaaattccagtatcaaatacctttctcacgtgttctgcagttatatataccttgttacttttatctttttgagtttctggatgatattctcccttatcatcaaaattgcccaataattcttcaacatctttacccatagctacatcatttgccatttttataatatttgcaagcaatcttaaccttaaagttaatttatcctttgaacctgccaagtattgagcaattctgacaacttcacaacatccatcgtaagtcattgggtttaagttgttgttctttatctcttgaactataaactgtaataacttatccctattttctagggtgttgtccattttattctttaaaactatcttatagtcaatcctatccaacagtggagctctcaaattataaacatcatccatgtttccagacattattaggatgaagtcacatggtattgggtttgtttctacagtggctccacttgaatttggatttctcccacttattggaagttgtttatcttgtagagcagttaaaatgtagtcctgaacttccaaaggcattgtttttatttcatcaacgtataaaattcctctgtgtgcctcgtgaatagctcctaatataatcctcttatgtggaggagttcctaatggaggtcttccacctaatggacagtgttttatatcccctaacaaccttgttacgttgtaagcacttgctcttacaagaggtctttttttacattcatataagaggactggctttaaatccattggatttagattatttggcattgaagcccttgaagcccccattatgcttgttaaaataattacaaatccaaagattaaaactattagagcagttatggttacagctgccagtaagtaattttgtggtaaatattttaaaagatattctgacagtagtatagcaccaatcattattagaagtaaagttgttgagcttggagctttaaaatccaattttggcatgtcttttgagtcttctttatactctccatctataacctcaactattggtctctccatattctttaaatttggttttgcaattacataataaggagtaaattcaccaaaatcagataaaatttctccaactgctttaactatcattgattttcctactccagggtctcctaataaaataacatttctcttattttttacagcagacaaaacaatttttacagcttcctcttgtccaataacttggtcaattaaccttggtgatggttctggcaattcctcagtagttttaaattttattgaaaacatattaacaccttataaaaatctctgtaaatatattgacatatataaatcttttaaatttttagttactattaaaaggaagatgccttatcataatatcataatcttatatttataatttttagttatggtgatatgatggatttagaaggatatgttagaagatgcctaagaaaaaaaatcccagaaaataagattattgaggatgggtttaagagaattttagagattaaagaagatgtagatgaggagtttgcaaaaaagtttataaaggcaattttagaggaggtaaagacaactgaaaaatttagagagattgatgatgagaatttaaaaactctactaaaatatccaaaatctggagtaacaatgggaagaatgggagttggtagtagaggagaaggagatttctttgttcatagagaaatagcaaggattgttaaaagcactaaagttaaagcctatgtttcagctgaagagcaagatgatgcagggattgttagagctgatgctaaatacatagttgcggcaatagatggaactcactcaaggcttagtgatttcccatttttaggaggttttcatgtaacaagagctgctttaagagatatctatgtcatgggagctgaggcggttgctttaattagtgatgtgcatttagctgatgatggagatgtagggaagatatttgacttcacagctggaatttgtgctgtttctgaggctgttaatgttcctttaataggaggaagcacgctgagagttggaggggatatggtaattggagataggttggttagtgctgttggtgcaataggagttattaaagagggagaaccaacagcaagaagaaacgctgaagttggagatgttattttgatgacagagggtagtggaggagggacgataacaacaactgccctgtattatggatggtttgacgtgatttatgaaactttaaatgtggattttataaaggcatgtcagaatttgattagaagcggtttaattaaaaagattcacgcaatgacagatgtcacaaatggcggtttaagaggagatgcttatgaaatttcaaaaacagctaaggtctctttaatatttgataaagagaaggtttataaaacaatcaatccaaaggttttagagatgcttgaggtattgaatatagacccattaggagtttcaacagattctttaatgattatctgccctgaagagtatgctgatgatataaaaaaggttactggagctatagaagttggatatgttgaggagggagaggagagttatttagttgatggaaataaaaaaatcccattaaaaccaatgtttagagaatccgcatatacgccagttaaaaaggttgttggtgagagaaaacctggagattttgaggagatgaaggagaaagttaggagagcatgtgatgaagctattaaaaagaaagattttgttgttgaattgttaaaagagagaaaaaagaaattttaatactttccttccaagatttttacagcaatttcctttgcttgctctctcttctccttcaaatcttttaaaaactctacaactctttcataagccatttttttgcatttaccacaagttagttctccacttctacatttttgatatatttcagctaattccttatcatctaagattaagtgatataaaaacaactcataaacaacacattcctctggaactcccccatacttcttatgctcttctaaagtctctcttcccccagtttttgctgagaatattttctttttaacagttttttcatcatcagtcaaaaatattgctgtctctggctttgaagaactcatttttcctcctaacaatccagtcataaatctgtgataggttgaagatggaggaataaacttaaactccttagctctatttgcaatatctcttgttaatcttatatgcgggtcttggtcaattcctactggaacaacaacgggttttggttctggacttaagttctcatcaagttgaggatgtaaaatatcagcaacttgaactattggggcaaagacgtgtccaatgtttgtttctcctttaaatccataaattgccttcatctcactccaatttgttcttttagataaaattaaagccaaatctttaaccttttgatattttgattgtaaatacacattaattttttctgggtctaagccaagagctatgtagttggttatatactcatttaaagcaagttcttttgttgtttcaaagctcatgtttcttgcccaatatgcctctaaatcagctattgggatgtttatattgtcagtgtatttttgataaaactttaataaatctaccaccattttatgcccaaaatgcattttaccagaaggcatcattccactaacaactgcaaactctttgttattttttattgcatcaactattctctcaaaatccctatgccccaatataatattcctcctgaagaaatgatgttcctctttcaaatctcctaaaacatcaactattggcttaactccaaactgctccatcgtctttttgtaatcaataactgctggagtttcccatggtgttaattccattagtttcacccttcattttgatataaagatttaaatacatcagttgtaatatatttattatgtattctctttaaggtgtcacctatgaggtgggcaatatttttggttttattaactataacattcagcggttgtttaaataaagagataagtaaggaagagataattaaaaagattgatgaaattaacacattttcttataacgcaaaagtgtttataaaccttagtgtttcaaatccagcaataaataaggttaatatgaaaatggatattgacggatacagtgatggaaagttatcaaaagggattatacatgtttattatacagttagatactttaatggtaggaatgagacaattcctttttatgtaaatgaggaaggaacgtttataaaattagagggaaaatggcagaaaataacaaataatgatttaagcaatcacacgtggaatatattagcttatataaaagacttaattgaaaaaaatgacataaaaattgaggaagaaaacaatcattatattataaggttaaaggatgaaaatgctgaaaaacaattaaatcctttcttctacagagggataaaaatcccaggaataaatctaaaaatctctgaagaggaagtagttattatattagataagtatggaactccaataaaagttattaaaaaaggaaaattgtatggaacttcaagtaaaggaaacttagatggagttatagttatagaaacggagattaaagatatcaacaaagattttgacttctcaataccagaagatttaagtatatataactaacataggttattaacatcattatttagttttattaacttatttgtttttgggtgggtgggatgataactaccacaactccttatattgaaggaaaaaagataatcaaatatttgggctttgtgcatggggttgcatcagtttatgttactgttaagtattatgaagatgttaaagatgcgtatgaaagggcattaagggagtcggaggatactgccctaattagaatggtagataatgcaaagaaattaggagctaatgcaattattgggattaactcaaattatgcaatggttggagaaaaaggagacatgataatggttggcatctatggaactgcggttgttgttgaagaagatggataataaaattaaaaaaattaaagaattacttttttagcaatacataaacatcatctccagtttttacattttttaaatactctgcattttcaactattcctccaacaatatttgttttttcaaagctttctccagtaggaccgaatttatcactctctcccaatctaaccccaatcattcccttatacctactaaccatgtttgttactccaatagagcagggttcaactttatccgttgggatgttttcaggcaacaagcctttagcatactcaggattccctttaaacattacaatatccttatgtttgaaatatacatgaagctttccaactctctttgttgttaatccagtagtttttctgaaataccatgctgtaattggagctttatcttcaaacaactctataacgattattttgttcttatccaatcctctaattttaactttcttttcctttaatacatctaaggtatattctggctcctgntcaacaacaattgcattttctaaatctccctctttctcnacttctatattgtattttttaaacatctcttcagcttcctctatagttagaccaatagcacacaacctctcaggaactgnttttacagacaaaactccagaatcagnaaagtcaataagctctattccttccttaacccttccaacaactgtgtgagataaagatgaactcctactttctctgnagatataaactttaccttctccaactccatagtttctgacagttataaatcctctctccctatcaattaaatttccttcctcaatttttaatgtctgcagtctgcaatcagcaacgtaagtatttgtgttttcagttatctcaaatattccatcctccattaaagctaaacaatgctctactgctgaaggagttccatcaaactcagctgtgaaataagtaaagattctccagccatcttctaattttaaatctaaatcagttgttactaagtaatcaactgcctctttctcctctctaattggctctatgtcaataattttatctccaacctccaatctatcaataacccacttacctccaacaacaataccaatctttgggtcttttaatccataaactccctcagtttttttctttatgaatacaatatgcccctcatctttatctaaaccagatatactcaaaacaacatcccattttttaaactcttttggttctgttgagatttctaagtcaattgtcgttgaaccaaatgctacatccattccactaacccatctgagcttctttacaaagtctttataattatttataaagaattttgctgtctcattattttcagttattgctattgttatattccccttagttgttttaattaaaaacttctttggtattttttcagcttctcttttaactccttttattattacgatattcgctccctcattatagtattcatcctttataacctctcttaaagtttctccaaccttttcctttccatttacaattaccttagccatagtttcaccagattattttgagattattattgtcyttatattgctcatctcttccattgcatatttaactccttccctacctaagccactcttcttaactcctccaaatggcatattatcctgcctaaacaatgatgaatcatttataactactcccccaaactccaagttttcagcaaattttaaggatttatttatatcgtttgtgaatatagctgaatgcaacccatattcagtgctgttggctatatcaatcatctcttcctcattagttctaattataggaattactggggcaaatgtttcagttttgcataaaatattgtctctatcaacttccaatattgttggatagaatagagctttatctctctttcctcctaataataacttacctccttcatctatagctttttctacaactttttcaacccattctgcatgttcaacacttattaaaggtcctacatcagttttctcatctaatgggtttcctacgttaagtacttttgccttatttacaaacatctctatgaacttatctgctatactctcatcaactaaaatcatccctacagagatgcaaacctgtccagcatatataaaactgccttttattaatgcattaactgctttatttaaatcagcatcttttaaaacgatatttggattaacccctcccaattccaaggcaatttttttaaagccagcttttttagtaattaattctccaacctttgaactgcctgtgaaggatatcatattaaccttctcattaacaactatctcatctcctacaacctctccagctccagttagcaaattataaactcccagtggaacattatatttcttcaaagcattttctatgattttagccaactctatacaaacaagaggagcttttgatgatggatgatgaactataacattcccagtggctatagctggggctattttatgagctgataaatttagagggaaattgaagggtgttatagccccaactattccaactggttctctccttgtaaaaattaatctatcatctgaagggattacctcatctctatgctctttaacatagaaagcagctaatttaaatgttccaatacttctttcaacctctactcttgcctgttttattggttttcctgcatctatagccaatattttggcaagttcttccttcttttctttaatttgtttggcaatattcattaagatgttgtatcttttagttatggggagatttttcataacttctttatacttttcagccgtatctatagcttctttagcttcttccctacttaacgcagggatttttttaataacttctaatgaatatgggttaataacatccatatcttccctatttatccacttcccatctatgaacatgattccaccaaataaaaagaatgttgtaactaatttataatttgtgcctctttcattttaaatgtttttaacaaacatttaatgtttatatattatgtgtgcttataattattaagatttttaggatttttaattttgttgtttggttgatggattgtcttgttgaatatgtttgaaatttgaaaataagagcatttagaatttattaattagttcaaaggatttttatttaatttctaagggtttgttaatttgattatttagattaaaatcagaccgattcggaatggaaacttttataaatccaatattgtctgttattagaattaaacctctcaaagggttcaaaacaagtggaaatctctttttattaaaatgttgatattgtaaatctaaatatttatattagtttattttttaatagagctttcacaatttatatattaaataatacatatagatgctaaggaaattaacttctcctttagtgaaactatgaaagtaagaaaattaaaaaatgctgaaattaatttaattgaggaagagttaagtaaatatactgataaggattttgtcaaaagctttaaatatgaaaatctaatagttttggaaggaaaatggctaacagtttgttatacaaatatagaaacaataaaaaaattaaatatgtttcaagacatattttcagtaggtaatgtatttggtgagattaagagaaaatttcgcttatccttagagggctttacattaatatctcccaatataataaataattatgcaattgtaaatgaaaaagctgaagcattatttttatatggaagggatatctttaaagaatcaataatagaagttaaaggttttggaagaattgctgtttttaataaaaatagagagtttttaggtattggactctttgacggaaagataattaagaatataaaagataagggatggtatttgagagagggtggataataattatcaagagtaactacataatactaaaatttatatttatccaaaattaaattttactattaattataatctgaatttttaataggtggaaacaatgaaagcaaaagaattagctcaaaaaattttattagatatttacagaaacttagatgaattttcaaaggatataattagaggagatttagcagatattgaatttaaaggattctatctaaaaggaaaaaacggagagaaggcatatattagaaacttagatgactttgaaaatttaaaagattttgatgtagagatgagaaaatacaaattaaaaagtataaatttaaagaacttagatgagggtttaatgataattaacttatcttcaagggtaagtaaggaatataagtttgaagcaaatgaatactcaataatctacccatcaaataatacaaccatagagtttaaagagagagtattaaaatggatggagttagaagatgatgaattagatgaaaaaattatagagtttgacacaaagatgaacgagattcttgaagagctgttggaagatgttgaagttgaagaagaaatttctgtctatattgatgtatttatggatgtgaataaaatagaaaattttgtagaaaaagatgacgaaagaataataatctggattcatcctgtctttttattctcaaacgatgatgtcttaagaggacttttagcttatgaactttcaagattcaaaagcagattcttagaagtaggttataaagatataataaaatactgcagagaattaaaaaaactaaccaacaaaaaaccaaaagttcttgaaaaaattaaagatattgccaataaatatggagatatagactctttaaacttaataaatgaaattgagaatgaataatttaacattccaattctttattttccgcatctttatcctttaaaaattcttttatagcaatttttttaagcctttcttttaactcatccaatccaatatctttatcagcagagatttttaatatttcttctattccaacctcttttaatttttcttcaatctctttaactctctcctcatctaccaaatcaattttatttatagccacaacaataggagctttaaacaaatcttttatctcttttaatagatttatttgctcttctattgtataaccacaaaattcactggcatctattataaataaaatcaaattagctaaataatttagagctaaaattgcctgtaactcaatatcattcctctcatacagaggcctatccaacagtccaggagtatcgaccatctgaatctctcctatataaccaacatttattcccttagttgtgaagggatagctgtttatttcaacatcagctccagtgagttttttcaatagtgttgatttaccaacgtttggataaccagctataactactgttggcaaatccttaaatgttggtaaatcttttaatttctctcttgccactgcaacaaatgccatctctggatgaatctgctccaatatagatttaactctaccaacaaattcctttcttaactttcctgcctgttgtggagttcttgcctttctaatttttcttgcatattcatttcctaattttctgaccaattcagaagcccatttaaatgctcccatcgactttttaaaatcatctatccctaccaagacctcaaccatctcctgataaaacttaggaagttttcttactggaggcgttttatctataaccttttgtaagttatctgcaacaactgaagcaatagttcttaccttatgctcctccacaaacctcgcttttagtaaccaaggtaattctttctgtctcatctcatttgctactttttctcctcttcttaaggctttagccatcaattcatcaggcatcaatattgttggcatttttttgaatggattagcttctctactcataattatcaccaaaaaagtttttaatagatttatcgataaaataaaattaaaataaatcttctaataaaagaatgatttttattttcatttatttaaaattttcaccactcctgtatttccatcaacaacaatcctatctccagtttttatctcctcaatatctattttatcaactaaaggaattcctcctaaaatagccccagtggcaactattggctcacattctttattaactataccctttaaaatccctctctttgctaaaccataaataacataggagccaacagtactccccctaccataaggaaatacaaagatttttcctttcaatgattgtccatataaatcgctatctttatctataatgttgccctcttcatcaactcctcctaaaaaagagaatggttttttagaaacgattgctatgccttcaataataccttttgatatacttcttccttttagttccataataatccctcaatcataagaaaatttacacctccgagcgttagnaaggggagtgttaagaggtatcctcactatagaagggctttgcccctctattgggatactccccagatagaaagtggggttgcctctggcaaccccgctctggagtatagcaatagaggctttgcctctatgctttgaaatacttcttccttttaattccataataccacttttaaattattcattcaaaaattacttcatttaaaaacttctcacaataatagcatctaatttttaatgggtttttactttctattttaaattttcctctaactttttctttatttgttatgcaatttggatttgtgcattttaatgtcccttctatctcatctggaatttgtggtttaagtttttcaacaacttttccgtttctaatgatgttgatagttacatctggagaaattaaagatattttatcaacatcctccttttttaattcaattccttcaatttttaaaatatctttctttcctttcttttttgatgggacattaatggctatcatcacagatgtctcttttgggacatttaaaaccttaaaaaccattaatgcctttccagcatctatatggtcaattacagtcccatttgtaatttttttaacttttaactcctccataggaatcacttaaaatttaaagcttttgttcaattttctctaatatttttagcatttttatttgtgtttcttttatctcattcaatacctctaattttttatttacattttctaactctccaaaaattagttttatccttgaataatttcttttttctttcacttggaaaatttgccaaaattcgaacagtcccatcttcatagttatacacaattccatcaattcctaaggcatgtcccaagttttcaatcctttctctaaatccaacatgctggattctaccgtaaataataatttcataagttgtaggcataaacttcaccaaaaataataataaaataataaaaaatatattattaaaattaaaaggaattattcctctttcttaaactcttctggattaaattcttcagggaactgtcctttaactactttaccagcatgttttggatgatatttatcataatcagcttctaactgcctcaatactgattctaatgactcttttaaaacatcaataaactcccatctttcatgttctgaaacataagctatatcttcaccttcagcctctaatttgtttggtaatgatgcttttggcctaccctccccaacatataatttatttggtgtcttaacataagttgttattctataataaggaactcctcctttatctctctcttttttgattgttatttttatccaatgaatctttcctgcatgtttaaccatctttttaacttctgttgcaataattctttcagcaaggtctttaaattctgggtctaacataccgtgtaattcaatttcaatcattgcccctttctttaaatcagcaatatatttaataatatccaatcttgtgacaattcccctcaatgattttcctttaacaactgggactcctctaatatcatattcttgcataactcttgcagcatctgcagcacttgcatcaacatcgactgttattaatggagtgttcataattaatctaactggctgtcccattcttggaactttttctcctttaaattctccagcagtcatctttttcttaggtttaaagaccttttttaatatatcgacttcagtaaccattccaactgggtttccttcatcatctacaacaaccaatctaccgatgttattgtctctcatcaaagctctcgctttaccaattgagtcattttcgtttattgtaataacattccttgtcattatctttgtaacctttgtatctttcattatttttgattttgcagctcttgccattatatcatagtcagttataattcctaccatttttcctacattattaactattggagctgctctctgcccactatccaacatctcacatacagcatccaaaaatggagtatcttcatgtacgcagtgtgctttatacattaacgacctaacttcttcatctgttgatgatgccaacaacaaatctctcatgcttattaagtaatattcttccttaccgtcttttttatcaacaactattaaatgatgaaatccgttctcttccataattcctaatgcctttgagacaggtgtatcaggtgttactgtaactacatcttttgtcattatctcttttactggttcgtttaacattaatctcaccttttaacagaaattttgatgattgatattatatcacatttaatatttaaagtttaacagcagttacgtattaagaaatgtgaatgtttaatttggctctattttcctaacaatattaaagaaaactttaaaatattttaaaatatcttttatcattatttgtttaaaaattaatatttgagtaataatattttttaaaaaatcgtaagatttatatattattttggcatgatatactgcataagtaatataatatacataataacctacacaaattaataaaaaatatataaaattattactcccgatgacggtctcccatggtgggatacttgagggaagtagtagaggtgggaagatgatggactggttaaagaataaaaaagcaatctctccaatcttagccttattaatcgtgttaggagttacaatagtcgtaggagcagtattctacgcatggggaagtaatttattcggaaacagccaagaaaagacacaggcagcagttgaagggactgcaacaaatatgttttatgatgctggggcaattagggttgcagcaacatgtattgacaaaataagataccaagatgctgatgatagtgattcatggttaggctatccaaatggtaacggaaaaattgcaaagccatctacttcaaatggatgttataattcaacatacggcacagtattctatgacgaaagatttattgtggaaattccagtaactattgacacacaagattataaattaactggagttaaagttgtaggaggaatcccaaaaatagttgatatgggtggaacttacacaaatgcctttgaagatatatctgcaaagttctatgcattctggttacacctaaatgacaactatcaattgttgaagaaagatggaacattgttcgttggatacgtaaataaatcaggaatgtttgaagttagtaatgggtatgtaattgcatggaatcagacaagagacacctatggaaaattggcttcttcagttggtgcaacatcagactccagctgggatgcagttaatacaacaactggagtagctccacttgtagagacttcatggccatattatggaacatactgtagtaatgttaagttatacacagctactggagaagaattaaaaccaggatttggaagtggaacattggttgcacaatggttctgcagttctgcaacatacttagataaactattcaacaacccagaatatgttgtaggaacattaccaaagaactcagaaaaaactgtaaaaacctacttattcttcaatacattatacttgccaaactacaaaggatctacaaatgatggatatgtgacatttgaagttccgttaaaagttgtatctaacgaaggagtaactaaagaagttaaagttaaatttacggtctatgatgatgagtagattttctaattttttcttttttatttatatacatccataaattcaaatttaatataaaaatctcttttcaaattctgaaaaaaataaaatttatgaaaaataaatattttttcatataaaaatcatactgttagttaaattttcatatttaaaattttctttatgaattatatagaaaattttatatagacgaaattcgtatatacataaccacctacattaaagaaagtttaataatatataaagtaatatttaattccaatgacggtctcctgtaataggatacccgaggaaagaacgaggtgatgtaatatgtttgaatggatgaagaacaaaaaagcaatctctccaatcttagccttattaatcgtgttaggagttacaatagtcgtaggagcagtattctacgcatggggaagtggattatttaataacagccagcaaagtactcagtcagcattagaaggaacaacatccacaataacctacgctgcaggagccataggtgttggagttccaaaagaaattgatgttgaaggagatttggatttaacatatcctactccagattacaaactctctcacttgactacaacagattatggctcatatgatgaaagattaatcgttccagttccattaactttagaaaactactatgattcgacattaacaaatgtaaaaatagaaagtgacggagccacagaagttgctggtttaacactcaaaaagattacattaaactacaacggacaaaactatgatgcatatttattatgcacaaatgatgggactccatttaaaggtatattaaatagaactggaatatacccagatgctacatggactggagatgatggaaacaactatacaagtgtatactacatattagctccaaactcagttactggagttgcagcagtagatggtagtaaagatttatcagttacaactgctaagaaatggccatattcacaaaatgatgtccaaagtatgaggttgtatgcaggaggattcaacaatatgtggtatgcatgtgcggttaatggttcatattcaagctggacaaatacattaacagctacaaaattcattggatggaacactgctcaagcattttacaaatacaaaacaccaatcgatgctaagttctatacttcagaatgggatgttggaacattacataaaggagaaaaagtttcaaaagaaatattcttcttctttggttcaagtatgggtttccaagaagagccaagtggagaaacaactgttaaaatccctgtaaaagttgtttccgaccaaggagtatataaacaagttgatgtcaatattgtattaaaagataggttataaattctcaccttttttctttcttttttttatctaaatagttttaaagatttaaatataaaataacctttaactgctaatatgtaataaaatatatgcaataaaatatttctttttggattaaaaaataattagaatttcaaaacaaccttaaaattatattactttttctaaaggtgatagaagagattgtcaagttaagtttttattaaatattgataaaaaataataaaatatgaggctcatgatagaagttataaaggagagaatcgtagagaggaagctttttaaaaggaataggaatcgatagaggttaaaatcttagcagggcttttatactacctcggattatcattgaggaaagtggtttatccccctccaaattcgaagatataagtcacgaatcgattagaatttattatcataagattaaagaggttttaaatagatttccaagtaatggtaaattcgatacggttgttagttgagtaaaaagcttcataatgttctataattgggtgaaatcgctgatttaacaacctctaaatcaaaaataaaagctaaataaacatttttattaaaaaataaaaaatttttatatgtgttattataaaatcatgtatccaaatattatctattttggattttcaattttctcttttagttctttaactttctcggcatatctcttgttaaatatcctcgctattctctctgtagcgtctaaaagatttaataactgctctaagtaatagtaaatatctccagagtacgtttgtattttaaactcttcatataatgtctttgatatctgtccaggagtttttccagaaatccttagattaataatcatctctaaaattttttcttcaacttcaactccctcaaattccataataattaaagttaaatcctcctttaacttcttatccttaattttttccatcccctccctaataacttccaaagcatcaaaaaaccttgaaggaacatttatattcaaaatttttgaaagctttatttttaaattgtttgataaatagacgttttcaaagggcataatttcagtaattagttttataatctctttattctcaataatcccctctttaattttttcagcaacctttggatataaaaatgaaatagcaactgcacttccataatttgttaatttcacatcattattagcttttatcattccataactctctaaattactcaaaattttgttcaaagaaaatgcccttccaatataaggaactctatctatatcgtatctgttagttattccagctgagattgtagctaatatctgctcttcctcctcatcctcattatattcaactttaacatcttcaggaactgcgtttaataatttaaatgccacttcatcctcagtattttccatctttgcatgatatttcttccctatttccaccaaaagatagaccttcccaatttcatgcatcccctttcttccagccctcccacacatttgctggaattcagcaggatttaaccaatcagcccccatagctaaactctctaagataacagttgatgctggaaaatcaacccctgcagataaagcggcagttgtaacaacgcactgaattttttgatttgcgaaatcatcttcaactttccttctttttatatattccatacctccatgatagaactctgctttaattcctttagattttaaagctttagctaaatactctgctctctttcttgagtaagtaaatattaagcactgccctctatatccaaattttgaaatgttctgccattctcttttaacaatttctttgataatatttagtttggcaaagtcatttttgcagaaaattatatgtctctctaaaggaactggccttccattatataaaactaatttggcatttagttgtttagccaattcctttggatttccaattgttgctgataaatatattttttgtgcctctttaaataaaaacctcagcctaccaattaaaccatccaatcttgctcctctctcctctaaattcaaagagtggatttcatcaataaccactgttccaatatcttttaatcttttagttctaattaaataatcaattccttcgtaagtcccaacgataatatcagcatctaacgatgtctcaacatcaactttctttccaatcctacctaatccaactcttaaactaactttaaaacctaatttttcatatctttctttaaattctaagtatttttgatttgctaaggcaactaaaggaactaaaaatagaaacttttttccagttttaattaaatttttaattcctgctaactcaccaattaaagtttttccagatgaagttgctgaaataattaataaatcatctccgtttaacaaaccagctttaacggatagtgtttgaacaggcaaaagctcttcaatccccctactctttattatctctttaagttcttctggaatatctaactcatctatcttataattttcaatcttatcttcttcactacctgttataatatcatatcttgttaattccggcttatccaatggatttcttattctcaacaaagatagaactttatcaacatctttaaatctctttaaaaatttctctataaattcttcgctaatttttacttcctctttgatttcattaatcccgcagtttatacatatttctaaatttccatatctacatctattatttcttgtcaatcttttgtagatattttttaataaacagaatgggcagagttctatataatcaaactttaaattgtatgattttaaaacttcttctatttcttcctcattttcttttaatataaatattttgtcagattttaacaactccaaaaccttagacggctgaattaacttatctcctactctacatctgtataatttgtatttatctccaacttttttgtaatttgcaaatatcttctgattatttttaacttctatcccatcttctatttttccacctactttaacaatttctatctcatcttttttcttttttggcttcctaacaataagcattataaatcaccgttcaaataaacattcaaataaagctatgaataaaataagttataaataattataactttataataacttattagtaaatttagtaaaacttttttggggatattatgaaatttataatgaaatttataaaatccaataaaggacaaatttctttagaattttctttgttagttatggttgttgttctctcagcaataattgtttcatactatttgataaagacagctatcgaaacaagaaatgcaaatatggatgttataaatcaaagttccaatgttgctgaaaaatccttaagcaatgtaacgtagtgtgaaaccatgctgttgataggtattacaggaatgccaggagcgggaaaaagctcagcttatgaaattgctaaaaaatataatctaccaatagtttccatgggagacgttgttagatatgaaacaaaaaaaagaggcttagaattaactccagaaaatgttggaaatacagctataaagctaagagaggagtttggaaatgaggcaattgcagttgcatgtctaaaatatatagaagaaaatttaaaagataaagaaatagttattgttgaaggtataaggagcttatatgaggttaattattttagaaaacataaacctttggttttaatagccattcactcttctccattaacaagatttgagagattgaaaaaaagaggaagggaagatgattcagcaaactgggaagtatttgtagagagggacttgagggagttaggatttagtattggacatgctattgcattggctgattttgtagtagttaatgaaaaaagctttgaagattgtttaaatcaattagacaacattttacaggaaattttaaataacttggaaaaatataagaaatataactttatttatgaaactttaagatagattcatttatataatatactattctgtttccctcttctttagattttacaattccaagattttccagtttttttaaattataccttacagtttcaacattcaaattcaaatctttagcaatctttcttaaatgagcaggactttttaataaatattcaaatatgcttttttgcgtttcattttttaaatataacagtggcaaatccctcatatccatatctgctggatagtaaattaatcgattaccaaattttttacttttaattagatttgctttttctaatattcttaaatgccacgtaagtgttgatactggtttatttaggtttttagaaagttctcttaaatgacatccaggattgtctaaaatataattgtaaatttctcttcttgtgtcatttagaaggactttttcttcatcaagaagatttatacgagagaggataaatacttttactgatgctagtgcagatattagctccaaaaacttcttttttagggtttcttgaaaagttagcattaaagatgcaagagttaagaaaacagtaaaaagtatatagggcagaggatttgatgttttcttaactatatgtatataaataagattagctaaaacatcctcatctggcttaaaaccaacatatattttattatttatctttatcgccgctggttttccgtctttatatcttgctataacctctcctttttctggtaattcatataatgcctcaacctctgattgttttaatttgagtgggtcttttatccagataattgtcttattgccattaacttctctcgaaccatttattgaagtaaaaataatagccatcttgtttgtatttacatttttctttgtaatgataaggttataacttttattctctattttaaatcttagttttttaattaaaggagctatgtctctatcaacttttatatatggaggaataatcacgaattcttttttctctccaatataaaaacatggagttccattctcataagaaagataaaccgtagtgttgtaaaggtattgactaacattttctaagctaacattaataccataaatatgtacataaataccataaacatgaacgatgcaaaataagattaaaattataagtaataaagtgtcctttttcatgatttcactaatctatgactataggtggaggatacatgattaaatagagccctaacgataaaaaaattaacgaaataaacaataataacaatccaaagcttatgtctatattaaaaacaccaacaaatataaacactgaaatttcagaaattattatggatgttgagactaaaaatgaaccaatgagcgttcttctcctttgcatttttctaattttcttcaattttattaatatttctttattgttttcttctaccacatacttcacctctatttaaaaaagatatgcttcaagtcctatttcaactgccacatcatacgcctttttatcacttaaaaatactctacctccatacttaacacccagtataatggcttttgctgaatttagaggaatatcataaatttcatgtaagtcccttgcaaggtctttttctacatcagtaagtttaataatagttatacctccaggtaatatatttcctaacttacaaccctctggaacatatactgtgccacttagtagttcaaggtctttaattgagaaaatccctttatcaacaatatatgaacgtctcctaaatattggaggaatcaacatagcagttattgaagtagttgtaactgtggctatagcagcagctacttttttaaatttttcttcaattattagtgggtactttctttctttctcttgtttattcatctcatttttagaaggtttttttgtctcctgagtctgtgacttctcttcttttttatgtctctgcatttggtttatagttttagatgactcttcgttttccttttcttcttttttcttttttatttctctttccatatagttataatatggaatgttaaaacttaaaccttcaacttttcctattccaataatgtatgaattatcaaccttaattgctggttttatttttatagtttcataaacatctcgccatgcataaaatttaagataaaaaataggaacataatctgaagtgatattaaatgactgtgatacattctcattaggttctataatataggaataattaccaaaatctatttttgtattattaacaacagcccaatagcttgcatttacatttaaagagacattcttatcattttttattatataaatagctgtccattcaatagaaccattacttaaaattttatttgactttattatggaaaatggtattggcagagaatatcttatcatcaatttagcgggtacttcaaaacttatattgctatctccgaaatataaaatatttgaattttgtatttttgataaagttattattttataggacttggcaggaactaagactgatgcatttttaatgttaaatcctcctggaaaagatatgttaaataagatactgtagggatagttattgattattttataatataccctccattcatctctgctgattctacttgcagatatagttatggatatgttaaatttttttggggggagattaagagttatattttttgaatatggaagataaaaggaggagtttctataagatatatagatgctaaaagcatcgggattttcataatctatatgtaacttagatacatcaactgtttgagaaccatttggataaaatacaacccccctatactcatatatttccccaaaacttaaagaaataaatgcaaaaaatagtataataataataattaaatataccgatctcatggtccccaattattaggttttattttttaaagtatttaagatttatagaacaattttttgacgaattatttttttgggtcaataccgataataagtccctcaactgttgttatattggttgttattgatatgttcattgtctcatttgcatttatcacattaaatttaaaccagtaggtgtttccataggttccattttcatcataatcccctgaaatattgattacttcaatattatctggcttataccaataaacataaacatctcttgttgtattatatgattttattgttatgttgtagccgtttggaagcattactatagttccagttatgttgaagaactttttaattaagagatagtttcttccaaattctgatgttccaataccttttatcgttgctgttgcagttagtaaagattcatctccaaccccttttccagaaacatttattgttccactgaaaaatccattactatcagcaatcaaacttcccaaataaatccaactttctccataggtatcattcaatacagtgccatctgaagaaatattatttcctattaaattatctccgccacttaaatttttaactaaataaatctcaactaccgcatttgcaaagtttgaactgccagttccatttccaatgtatcctttaactgttaagttatctccgtttaactcagcataggtaattattggatagtcaataccatgatttgcttcattatagttcaatagcccatcatttagagttacattatcatcatctaagtcaattccgagtagagagttgttgtaaattgagtttttggagattattatattgtaaggaacaaaatcccagtttggaattgtaattcccttttcattgttgaagattgtgttattaattatgttgatgtctttgcttgcccctattaaaattccataggcagagttgtttgctatgatattctttgagatattaaattctaagctaatccaactctcatttaacccataaacctcaattcctccaacttttccaccataagttggatttggacagagattgttgtttattattttattaccctctattattatatatccattatcttgattataaactccataagccccaacagttattcctgcggttatatttcctattgtgacagttaatccattgtattgaattgtgttgtttataatggatatatttgttccaatccaatcccaagaattccatccatttgcctcttgaattaaaattgcctgagcatcgctgtattgaatcgtgttattaaatatagagacattctcaactcttcctcctatgtatattccattaccgctattttcttcaataccattatttgaaattatgttgttttcaactttaacatcacataatgttctgctccacaacccttctaaagaaataccattacccaagttgtgagatatattgttatttaaaattaaaactcccttggtatagtttccactgatttttattccacttcctgctgggtctcctccaatcaaaccgttattggttatgttattattaactatgtttatagcatttactccatagatgtaaattccatctttgtaggagccgtttattagtgatttggatatatttacatttgaagcacttcccaacgaatagataaacaacccatagcttccgctgtttaatacacttgagttataaagttttaaattattcaaaaatccatcagaagggacttcaatatcaatactgttgtttattgaatctcttaataatgaattcaacacactgaggtttgataaattaccataagagagtattgagtaattgttattatacaatagagagttttcaacacttacattttctccattaaatattgcaattccatctgtgcttgcattaaatatatttgatgaatttatatatacgttagatgaattaactatttcaattccataggcattatatgaaatattcgatttttgaatttttgagatgtagttttcttttaaatatattcctatgctattgttcattatatttgaattcaatattgaggaggatgaattctctaataataaaccttcatatctatttttatatataagggaattattcaccaatatgcttgatatatttgcatagattccaatagagttattaattattgaagagttaagtatttctaaagttgagttctttgaatacactccctcataaacggaattcttaatctgagagtttattagttttattccatttccatctttatataaaaccaatccttgattacatgagcttatagttatattatagattgttatgtttccaaaaccaccagcccagtttgcccaataaatccctacaccgttttttaaagatatttgagagttatacaacatagcccatattttgttcaacattgaaattccatatcctccagaggcgtttattgttaaattgtcaatatacaatggataattctgcaaactccaatcataatcaactaacttaacccctgcatttaatatttttccataaattccacaactctttaatgttaaattatttagcccagtttcatttcctaatattccaacactgacattttcaaagaatatatttccaatgtatgtatcagcccccacattgtcaataattggatttggagatatttcttcgagatttaaaacattatccccatttttcacatatgttggcttaacgtattgtaggttttttgctcctcctgttcctcctgtgaatccgaaataagttgagtttcctataatttgggttatgtctttattccatgttaatgctaaattgccatcgaaatatacttggagtgtttttgttgttgcattccatacgatttttattaagtgttctcttccatcctcaacattacctaaatcgtatgggtttggtgttgagtaagttaaggagttgtaagtgtgatttaagttcccatcaacatctattgcaatatggtcggttgttgctgggctgtcaaaatcgttaagccaagtatcaacctccaccgctacactcggagaaattccaccataacccaaatctcctccagttccacctaattcgttagtccccaacgattgcaaggtaaaggttataccatctgctccatcaggattgtctcccaaatacgcataaaactcaacaaccaaatcctcagatagattaaccggcttgtaataccaaacactacctttttggttgtagtcatcaggcgttagtatcaaagttagattatttgaattatttatgtatgcgttaccgttagctatccattgtaatcctgataaaatgatggttccattaatctgagttgaaccattgacaatagtcaaattgtctaatattttatttccacttgtataaatgtagtgatttccattctttgcgtcgatatttggtattctgaaataactctcatctttcccataaattgcatttgcattttttataaattgggaaaaactaccctgccccgtagatttcgtatttgttattacatcaaagctgaatccaaatgttatatttttcccactatatgaatttagatttatcaaacagtagtgttcatattttccatcttcccaattatcttcttcattagggtctcttcctccaaacatctcaactactccataagttggatttattatatacccatccccattttttacgtatattggcttaacatactggagattttttgctcctcccgttcctcctgtgaatccgaagtaagctgagtttcctataatttgggttatatccttattccatgttaatgataaattgccatcgaaatatacttggagtgtttttgttgttgcattccatacgatttttattaagtgttctcttccatcctcaacattacctaaatcgtaagggtttggtgttgggtaagttaaggagttgtaagtgtggtttatgttgccgttaacatctattgcaatatggtcggttgttgctggagcatcaaaatcgttgagccaagtatcaacttcaaccgctacactcggagaaattccaccataacccaaatctcctccagttccacctaattcgttagttcccaacgattgcaaggtaaaggttataccatctgctccatcaggattgtctcccaaatacgcataaaactcaacaaccaaatcctcagatagattaaccggcttgtaataccaaacactacctgcttcaccataatcatctgttgttaatagaagcttatctgggaatattgaagcatttccgttggcaatccattgagaagagtttattggagtatatactgtttgatatgtttcttcagcccagatgtcatttttgctatattgagggtttaaacctcttgtagttcctacagttcttgaattcactaccacaaagtaagtttttgaggagttataaactaagaaggaataatgaccaaaaatatctgttgttgttgaatttactatggtatctccaatatctggaataccatcattattgctgtcttcaagtagagatacattaaccccataaattcctttatcttcactatcttcttttccaagggttccaaagtcctcttttacatagccctgaatttcatatccgcagtatatggtatagtttttcttcgaaattacaccattagattcgattccagttattgtaataagatattttcctgactctgggaggctaaatgagtaattatagagcttccaaagtgatggggagtttttatctatttcctgtagtagcattgaagagttgatatatacactaccgtttggataatacacagttatatttgccccgcttatatcgtaagaaccaatagggtctgtaatatttgcaaatattgtaacattttcatttggaagataaacgtttttatctgaaaatatgttataaacattaacataagtcgtagtgtttagcgttatattggatggatatgttgaattatgatagatgtttattgagttagaagatatttgattttccactctcaaaaccaaatagtagtttttgggtattgtaattattgaatctaaggttatattgaaaatgtaagattttatagtatcatctaagtatagatactcaacatcacttcctaaagtaaaggaatcaattccatttgtggccattaacgaaacaacaattttatgcatttcagttccaaatataacgtttgggtcatttatataaagcaaaattggaatttttcctacaactgtaaagttgtctgcgaatcttggatattgtatccatgaagctaatgaattgctattaattgttgtgtagttgttaattgttgtaggtattgaagtatttagagttcttaaagtatctccatgtaaatagaaagttttttgaactgaaggaggatatggtgttgatgtctggaatgttgtttttccaaatattgatggattatttatattaacaaattttaatgtagttgtatcaatctctcctaatggggctgttgaaggaattgtctttgagacagttaaatttatctctccagttggcacatagatatctggcaaattatttgagtttaaatcataatttgggtttatataatcccagattccatccccattggcatcttcagctattaaaatggagttgttgtatattttcgttgtccatcctttcgttaagtaggttatatttatatcaaatcttcctccaactccaaagttatataatgttatattgtaaaatatctcttctccaacatttccagtcttttcctgataatttggttggactgaaaatgatgttatatagattataatgcttttttcatcgtttgatgtattctggtcatttggaagatttgtctttattgttatattgtaggctccataaggcatatttgagatgtttactggaaagctcacgagtttttcttcttcataaggaactgagaggtttattaaagttgagtttgtataaatataagttccatttatctgtgttatattaattgacacattcaagttgtatgcatctaccaatccatataaggcaattgttgaatttatgtatattattgggccaatatttgggttaaagctgtctccattgtttgggtaatctatacttttaactccagtatcatataactggcttaaacccatatttatttcgttcatcatgtctgtatagttataacctaacccccaaattattggcactacccaaatttcgccaggttttaatgaatctttagtccatgctaatgctgtccctgcatcaccctcatatgatgaatcattatttaaattatcatatctaatatcagaccacgtactccagtacaaattaacatcatgttcgtaacttgggatatttgatttaaaacctccgtattgtatatccccaacaggtgcgttagaatcgtagccatacacaacatcatcaatactattatagtatgcatcatctccccaccagcttcctctaaaattccaatccatcccttggaaaaactttaaatttgtatatgtttttgtggttggattttttatgtagtatatggtagcaaaccatttattatttcctctaataataaccttttgagtaatatttagctcattattattccaaggagcatacatatctgttataattacactctctaaaatcccatttggaacggtatttaaaggaatatctgtcctatttatttcagataggtaataatatgtccaccatcccaaactacctgcagttcctaaaaccccatactgtcttgttaatgctccacttgtatattttatcgctatttttgaaccagcgtaagcatcaatattatttgcataattgtaatctccagtcctccctgcatggtcataagtagccacggtagtttcatcatcctccttattatatggaaagacaattgctgaaatctgcccacaaccaccataatcttgcccattataagataattcaacagctattgaatgatttggagctggaggaattaaagatatatcatatccataaataggatcgtcgtagaagtatagtgtgttattttcaatataccatcttacttctccaataacctctcctgttaatctatttattgaaatgttatttcttattactcttccatcatctccaacaatttctttaaccctataaccttttggaatcttacagctgaatctataccaaaccccatctactttattattaacttcaactctaattttattactgcttatttttttcactatctcagttgtatttagaatattttcaggtaagttgtaatcttttagaatttctttatctgctttaagtttgatttctacaatactataattgtaaatctttactatttttgaaatcttgtatttttttcttttttcgtatcttttcaataacttcttaatctctttttcactaccttcaagtttaataattatctccttattgactgggtcataggaaattagctttttaatttcttctttatttttgaatttaacttttatcttttcttttgcatttccacaaattaaaattatttttttaattttttctggttttgagatatttaacttgggtattaaataatctaaaggaatttcaaaggccccatttattagtgaaatattaatttcttttttatctacaatgcaagttataaacttcggttctttaacatagtaggatacgtttccaacgataaatctattatctatcaattttgcattaattttgtaataatctacagcaaaggtttttttaatcccatcaacaactactgagtaatttcctaatataacattcttttttagttttgtggataagatataaaacttcccttttttatgaacttttagatgtattattttattgttaggggttacaatatatgcagtatgtggcttaaaatttgtttttataactattttttctgatgggaaataaacgtttttcaatataacggttttattcgttgtcgtattttcctcgatagagtaatttaaaaatattgttctattcaatgtctcatttttgaattttgcataaataatgattgttttatttagaattagaggatataccaagtattcatgtttttttatttttttagtcttaacttttatattgaggtctaaatatttagcatagggtttcccatttgttttaacaatcaacttaaaattgttgaatgagacatttagataatgtaattcttctttttttatgtttgtttcttttttttctttttctggttttgtgtaatttaaaataactgttctatgtaatattttatcattgaattttgagtaaatttctattggaacatttaaaactattggagagattatatattcgttatcacctattttgataaactttaagggcgttttatttgcaaatccaaaaacttctccattagtttttactataactctataaccattaatagtaatgtttaaataacactcatttttttctttgtttgtatctgttgtattattgattattatgctaccactattattagtggtgtttgttaaggaattgtttaacttatatatcaatgaattatttaattcaaaattactgttgttgtttgttgttgatacatttaaacctaaactcacgtttgaaagcaataaaatagtgaatacaaatattgaaatattctttaaataggatttcatattatcccattgaaatttttaacactgttcaaaagtaaagtaatgtataggtagtatataaaatttatagaacaaatattagacaattattgagattattagtttttattcttcttatcttccttattttctttatttttttcttctcaactcagtatagacaaatattattattaatatacacaatatgcttaaccaaaacaccacatatccatgaactggaagtttcggtaatggcaatattgaaaactcagcatttataataagcaaagtttttttagggatttggaaattatttccatctggttcttggtaggttagataataaggagagacaaagtttatatggaagttttttatattcaaatcccctccaataggaattgagacagttttaaacaatattccattatcaacaatatcagcatcatattcaattattagagttatattttttccaccatctattggctcccatacttgatatgttataactgaataggtatctttataagagacatttacatccattggatattttttatccccaattatataataaccccttaaattctcaatctttacaggtttttttcttttgtaaatggtattggaataatcagtattttctttgactcttctttttgtaatcttaactccccaattcctggaacaagaggatacttaacaagattttgaatagttataacatttgttatatgtgcaggattttttgttaaatcaacggtcatattatagtttgttatttcctcaacatctgcaaaagttggtgttataaatgcaaggaaaataaagagtaatgcaaatctcttcatcatcatcccccaactttatttattattccttatattcctctttgttaatatacctaatccaaagataacgtttatcagtattaaaaatatctcaaagttgttttctactgttccggctactgttgttatttttggtgaggttgttggtagtagtgagtttgtagggtcgataccaacgataaatgcgtcgcttgggtagaattcgccagttccgtttagtttgtagtgtatgactactgttttatttgcaagtatttcagcagtgtcgttccagttaccgtccccatctgctcctggatatattgcatgtaacgcccaccacatgcttaaattataccttggatttgttgtaatggtgtgatttccttcagcaatcaacatacttgattgattaacccactcatctgagacggtgaagttcttaggaatcaaatcataaacatacacatactcaggagtcttcacactaccaatattctccacaactatataaatatcataagtcccatccgcatccggaacaatatgcttagtcaccttaatcaaataactacccacaacataaatctcctcaacaacaacataggaacttcctatttgacttacttcatttaaaaggatataatctttttttgacagtgtaaatgagcagtttgcccaaacgattggaactccactaaatgtgaagttgtaggttttagagttccatacttctcctggaggtatgtcaatatttggagttatagtgtaattactcccatctatccagatagatttgttaaatggattccaatacaactcataagcagatttatttactgcccatatattaagattcgttaaattaaaggaatatgattttgcatcatttttaaatgttacattttctatccaaatgtttatttctcccgtagttccatgatctgttgaaatactataacttccagatgcataaacaccttttatagatgtgtttgtattggtcccattgtaattaaatagtattttagcaaatccatactttgctaaaatattatccctttcactatatgaataatttcccaatacattaaataccaaagttgcactatcattactccaatttaaggtaatatttgtccaatttattgcatttagatttgaggtattgtaatcttttttgaaatagtccccatcaaataaaactgctgttccttcacttgaatttgcagatgttatttcaagatacttccagtttttatctccataaaagtcgaagttttttgaattcacttccaaatcatcaacataataaacataacctccatgaataacaaccctatcaaactttgtataggtattgtctattgttgagacagttgcggctaaggaaccattttgataataagttgagaatgttattgttccatttgaataaatttttagttcgaagtaataccattcatcctctggaggattccaataaacttcaggactaatttctgtaggatttccattagttcttctatcaattgatatgtaattactgtagtgatttacctcaaatgaatatccatcaaaattctcatcctccaaaccaatcctgtctatagggcctcctccccagttgctcggtctatatacccatccacttataactacatcccttccaatttcttttggaagtaatttgtaccctccatttggatcgttgtttaaacttgttgaaatcccatatttttctaaagagtaatttccagaatgagattgaatagatgaccattgaactatcccgttcttatactgattccaaccagtccaattttcaaagttatcataaaactgcccattacttagatattttataacattaacattgacattttctccattaggaacgagatttttgtttaaatatacaattaaatttacagtccattctgacattttatttgctggtatttttgtaacatcgtaagtttcatttactaatattggtagggtttgagatgcatcgatatcaaactcatattccacatagctgttatttggtagtattgggatgtgtatgtatgtgtttgcatttggtaagtttgtataagcaggagcagaactctcaataaaaaccccttttggagttccattataaactaatctcaaaccacttgcattattttttatatccactgctacccacacatcgtttaaagtatcttctttataaggggcagtattttcaataatgatatgtcccgttaaaccataggaatagtttgtttttcctgttccatccacagtagcagttgcgttgtactcttcaatatatcttacccttagtggaggatataaatctgaaatcctcaaatcatcaacatagtaatcttgtcctccatgcacaacaactctatcgaacttagtatagatgttatctattgctgagacagtagctcctaatgaaccattctcataataaacttctaatcttaaagttccatttgagtagatataaaacttaaaataataccactgattttctggaggattccagttagttattactaaagtatttacagcaataccattttctcgagtttctattgcaattttgttatagtcgtgctctattcttatagagtatccgttgaaattctcgtcctcaatacctattctatcccatcttccgctaacatatggcaaaggtctataaatccaaccttccattacaatatcccttccaatttccttcccaattagtttgtatccaccatttgggtcatcatttagaaactttctaagggaatatattcctgaatgtgcataattagaagattgctctacagccccactactgtagttataccacccactccaattttcaaaatcatcgtagaatattgtttttaatccagaaacactgtttaacattgatgccataaatacgaacagtaaaatacataaatatatgaattttaattttatatttggcatgccccacatcacccatataatatcgataaaattaacttaatgtcaaaaatcatatttgaatttagaaaaagaattataaaaaataaagaaaattagttttacattacccttcttattatgattcccaaccctacaagtagggtcaataatgcaaggaatggttctgagttgttttctactgttccggctactgttgttatttttggtgaggttgttggtagtagtgagtttgtagggtcgataccaacgataaatgcgtcgcttgggtagaattcgccagttccgtttagtttgtagtgtatgactactgttttatttgcaagtatttcagcagtgtcgttccagttaccgtccccatctgctcctggatatattgcatgtaacgcccaccacatgcttaaattataccttggatttgttgtaatggtgtgatttccttcagcaatcaacatacttgattgattaacccactcatctgagacggtgaagttcttaggaatcaaatcataaacatacacatactcaggagtcttcacactaccaatattctccacaactatataaatatcataagtcccatccgcatccggaacaatatgcttagtcaccttaatcaaataactacccacaacataaatctcctcaacaacaacataggaacttccgtactttgttgagtattcattaatacttctatttattaatgttatgttctcgtctgctaccttaaatgtacagtttgcccagacaactggaattccatcaaatgtgaaggcatatttagttgaactccaaacgcttcctggagataatatttcattaggtgaggacgtctgttttgaattagggattaataatgttatattaaatgggtctaatattactggattactaccatttacagcccatattgtcacatgagttaagttaaagtagtaacttgatgccttgtttgatacattagcactttcgtaccatatttcatacttaccgcttgatgcatttaagaatggtccttccttggttgcacttactccaccatatcctgttgcataaatcccttcaatttttgttcctgatttagttccattgaattcaaagaagataacagcaaaaccatatttcattaaggttcctgttctatttgtgtaagtgttgtttcctgttatgttgattgtaatggttgcatttttagtagtatttattacgactcctgtccaggttaatgaatcgttgtatcctggtaagaagtaaggaccatcccagagtgttattgaaccttcgttggctatagcacctgttatatttaagaaattccaagtgtcacttccataattatttgggtcgttacttagatattttgtcataataacagaaactggtgtatctgttgccggtagtgctgaaacatttctgcttatgtttaaatagacactccaatttgataatctttctgatggaattttagtatcactatatgtttcgttgattatcaatggaactccagttattgatttatctatagcaaatttaattataacatagctgttatttggtagtattgggatgtgtatgtatgtgtttgcatttggtaagtttgtatatgcaggagctgaactctcaataaaaaccccttttggagttccatttacataaacttctggtccagttatgttgttggatatattaactgccacccaaacatcgtataaagtatcatttattgtagtcccagtgttgttaattacaatatatccagttatactttctattgttgaagatactaagccatcacctgtagtgttacctgttatgttatatttttcgtaatatgccacatatagtggtccattatctccatatccaaatacagtcccaataaacagcaatgacattaacaaggccataaatattaactttctcataacttcacctcatgcatttgtgtgaaataggggaacattcttaagtaggtagtaataatgtaatgtcttccgtttgtataaataatttatggaacattttttagacatttttgatttttcaaaaatttagaaaaagaacccaaaaagtccaaggttttcaatttgaaaataataacagccgatatataaaccttttgatattaaaattatcaatacctaataaaacattttaaaataagcaaaaatattaattcaataacatattgattccttccattacagcatctacagaagcccttattatatcagcgtctgattttctaacttcaacaatttcagttccttttcttaatttaacaacaacctctattaacgcatcagttcctccaccaattgcttcaactctatactctaccaacttaatatctgcaactccacttattgcctttctcacagcatttattgctgcatctaccggtccaacaccataagcagtttctattaaagttatatcttctcctttataatggagtttaacagatgcaattggtgttattttatttccagatacaacagttaattcatctaatttgattttctcttctaccaattttccagtaacttctctaactatagccaacaaatcagcgtctgaaatgtatttacccaaatccccaaattctttaactctttcatatattttatttaattgctcatcactaacgtttatgcccatcaaatcaagtttgtattttaaagcttttctaccagaatgcttacccaaaataattcttcttctattcccaaccatttctggttttattggctcataggtttcagtattttttattaatccatcaacatgtattcctgcttcatgagcaaatgcattgtccccaacaattgctttatttggtggaacaggaagtttcatcaatcttgagacaattcttgaaacctcatataacttttccatctttatcttagtatcatagccatagagtatttttaaagcagcaacaacctcttccaatgaggcatttcctgctctctctccaataccattaactgttacgtggcactgaacagctccacctaaaactgctgagcaagtattagcagtagccattccaaagtcgttgtggcaatgaactgagaccggtaaattaacattttcagttatttttttaaataattcctgactcttttgtggagttaaaactcctactgtgtcacaaacacaaactctgtctgctccaaccttttccccttcattaaatagttttattaagaaatttacatcacttcttgttgcatcctctgcagataactcaacaatcaatccatgttctttagcatactctacagcctttaaagctgtctctaaaacctcatcttctgtttttctaagcttatatttcatgtgtattggagatgttggcactactaaatggacactatctacatcacattctaaggcagcatcaatatctacaggtaaagctctaacaaatgagcagatttctgcatttaaaccttcttttgttattaattttattccttctctctctccttttgaagttatagctgaacctgcctctataacatcaactccaagctcatccaatttttttgctatctctaacttatcatttggtgttaaagaaactcctggtgtttgctctccatctctaagtgttgtatcaaatatccttaccatcataacaatccctcataaaaaataatttaatgaaatttaaatactcataatgaatctgatgataaaattgaatcatctcaaagatatttgatattgtatatttaaaatttatgtgggaaatagttctggactaaaaagttggtaatatacatctttaaatttaaatttataaattaagatttcttttaaagattttattcctgcgaaagccccattaactttattaataatctttataaaatttttattatttttgaaagatactatacgaaagtcataaaatactcgcattaaagatttaatacaaaacaatagcgaaatttttatatttgttaaaatttacttacattaaaacaagtagtttttgcaaaagttattaaaattaaaaaataccttactaaaggaaggcattcattactacccatatattcttttaaaatgctccgcaaaaactaaaaatgccaatttggtgataaaatggaaagttacatacaaaacttatttgctgagagaattggtggaaagaagtttgggaaagaagatgtaatttacaagtttgagaaaattaagagagctaagcaagaggcaatgaaaagacaccctgatatggaattaattgatatgggtgttggagaaccagatgagatggcagacccggaggttataagagttttgtgtgaggaggctaaaaaatgggaaaacagaggatatgcggataacggaatacaggagttaaaagatgccgttcctccatacatggagaaggtttatggagttaaggatatagacccagttaatgaggttatacactcaataggttcaaaaccagctttagcttatataacatcagcatttataaaccctggagatgtttgcctaatgacagtccctggctatccagttacagcaacacacacaaaatggtatgggggagaggtttataatctcccattattagaggagaatgacttcttaccagatttagagagcattccagaagatatcaagaagagagcaaagatattatatctcaattatccaaacaaccctactggagcacaagctacaaagaaattctacaaagaggttgttgattttgcttttgaaaatgaggttatcgttgttcaagatgctgcttatggagctttggtttatgatggaaagcctctttcattcttatcagttaaagatgctaaggaggttggagttgaaatccatagcttttcaaaggcattcaacatgaccggttggagattggcatttttggttgggaatgaacttataattaaagcgtttgcaacagttaaagacaactttgatagtgggcagttcatcccaatccaaaaagctggaatttattgtttgcaacatccagaaattacagaaagagttagacagaagtatgagagaaggttaagaaagatggttaagatattaaatgaagttggatttaaagcaagaatgcctggaggaactttttatttatatgtaaaatcaccaacaaaagctaatggtattgaatttaaaacagctgaggatttctcccaatacttaattaaagaaaaacttatttcaacagttccatgggatgatgcagggcattatttaagattagcagcatgctttgttgctaaagatgagaacggcaatccaacaactgaagagaagtatgaagatatggtattagaggagtttaagagaagattggagggaatggatttagaatttgaataattgatttttatttattttaaatttttcatatttttatttttactattctttatttatatattcggattaataaaaatatctaaaacctgttctaaaatttatttatactaaaatctccactatatacaatcaaatagaaaaaaagaggatgtaaaatttttcaaatttttgaaagaaatgaaaaaaggtgaaaggtatggatgagtatgaaaaaatcatcaatgacttaaataccataaactcaaaagcaaaatttattggtattaagattattatggtaagaagaattatcgatatgcataaagataatgataaattaataaaaaaggtattagagggtataaaaaatactgatctttatgatttagttttaaatgcatgtcctgaattgaaaggagaaaggattaaagatgtttattttaagaagaatgattattttaatgtcattaaaaagacaatgagcagtgaaaatactgtattgaaaaatgtgttgattaatgatgaatctccgccctaaagatgggaattttaggagattatgggttaaactttcatcctctcctgctccatcaaagccatatttctgaatgcttatgtcataataataaacatcttagaaagatatttatagtactacaaagtcataataggaacaaaattacatgaatattcaaaaaaattactaaaaaaatgaatcaataggcgattaatatgaaggcaacagaaaacagaaaagtaaatgaaataaatgaaattcttctacctctatcaaaaaatttaaagaatgttgagggatttgtcatagtctcaaaggattcccttgttaaagtaggaaatattgacggagaagatttagaaataatatcaaggcatatggctgttgttatgggtagttcagagatgctctataaaagatttaatgatgaagtcgaatacattgaaattaaaggaaaaaagcataaaataatcttatataacttagatgattttatatttgcagtcgttggtaatatcaaagctgatgaaataaaagataaggttatggaattaaagtttaaagttaataacattgacggattaacagctgagaatattattgaagagattgctctttaaattttaaaattttaataggacttcatgggaataaaccattataaggaaaaatacggttaaatgtgcttaaaaatagaaacatggaatttaaactctttgtgatattatcaaactaatattttaatgaatttataggcataaataaaccaataaacatatagctatattggagttatacctacataatatactacacagtaaattacgcaaaaagattatatgtaataaaaactatatgataataacaagggactttaaaaaatgattaagaaacaattaaaattgtgggggaggggttaaatatatataacaatagtcaaagcagcttttttatttttaaagaatctaagaagttaagttccttctctccaatcttctaaatattttttttgctctttagttagttcatcaatttcaatacccatagctttcaattttagagaggcaatcattaagtcctgttcgtaaggaatgttataaacccttggctctaacttctcatgattttttaagatgtattcagccgctaaagcttggttggcaaaactcatgtccataacctcacatggatgcccatctgcacatgccaaattaaccaacctaccctctcccaataaatatattttcttatttcctaagtcgtattcagttacacaatttctaacttcttttattgatttagctaactcttctaagtgctttttattaatctcattgtcaaagtgtccagcatttgctaagatagctccattcctcatcttcaatatatgttcctttctaataacatccttacatccagttgttgttataaatatatctccaatctccgcagctttctccatcttcatgactctaaatccatccattcttgcctctaaggctctaattggattaacttctgtaactacgacctctgctcctaagcctttagctctcattgctactcctctaccacaccatccataaccagcaacaacaacagtctttccagcaattaataagtttgtagctctcagaattccatctaaggcactttgcccagttccatatctgttgtcaaatagatgtttcgtatatgcatcatttacatccataactggaaattttaaagctccttctttttccatagcttttaatctgatgattccagttgtagtttcttcacaacctcccattatgttatccaaaagttcagttctctttgtatgcaataaaaatattaaatcacagccatcatctataacaatatctggtttgtggtctaaaaccttgtttaggttttcataatactcctctactgtctctcctctccatgcataaacatgcattccttttttagcacaagcagcggcaacatcatcctgagtggataaaggattgcatccagttatagcaatctctgcccctccttccatcaatgtctctgctaaaacagctgtttttgcttctaagtgtagagccattcctattgttattcctttaaatggcttttcttctttaaatctttctctaattaaatttaaaacaggcatgtgttgttttgcccattgtatttttctctctccttctttccagaggtttatgtccctaacttcatacattcatttcaccttaaagaattaattttaaaaattagtagggtagcagagatatataaattactattttttagtgaagaaaagcttttattatttataaattcaaatatataaattaaattaataaaaagaaaataaaccttaaatttttattctgaatcggtctgattttaatcttgtagtttccaaagaaggacaccagctaatgtttccattccaaatcagtctgattttaataggacaatcattcacaacataacttatttacttacttaattaatcttaatttttaagtgtgtgacagttaggttaaactttttattagtattatcagtatattaataacttaaactctaaaaaatagagaggagatttttatgtttctattagacccattttctggaattagtggagatatgttcttatcagcaatgattgattttgttgataaagaagattttataaatacaattaaaaaagttattgatgtagagattgagataaaaaaggtaaagaaatgtcatatattagctaacaaagttaatataatcccaaagtgtattaattgtaatgcaaacacttataaagatattaaaaacgttattaaaagttctgatattcaagaagatattaaaattactgccttagaaattctaaagatattggctgaggcagaaagcaaagtgcataatgtggatgttgaaaatgttcatttccatgaagttgggaattatgatacaattgccgatattgttggggcagcatatattataaacaagttaaatctaaaaaataactgcttatataagccaataaatgttggaaatggttttgtaaggacagaacatggattactaccagttccagctccagctacggctgagatattgaaaggacttaaaatatttttttctgatataaatgaagagctaacaacacctactggatcagctattataaagtatataaatccaaaattagctaaaggggcttttattataaaagaagtttcttatggagctggagataaggatttaaatcttttaaatgccttaagagtttttagagttgaagatataaagagggaggatatagttttattagaaacgaacgttgatgacatttcagcagagattttaggctatttatatgaagttttagatggaaaagttagggatttgcattttatccctacatatatgaagaagaacagaccagcttatacaattagggctattgttgatagagatatagctgaggaggtagccaaaattataatgagggagactggtagtttaggggttagaatatttgatatagagagaataacagctgatagagaatttaaaactataaaattgtttgatgaatctgttagattaaaagttgggagagttaatgatgaaataatctctcaaaaaccagagtttgaggatttgaagaacattgctaaaaaatatggcattcctttaaaagatttatataagttaataaatatttcccaaattaaaaattagatttacaaatctttttttagataccttattataatccaaaaaccaatacctaataacgctccagctataaagttatctaataacattccaacacctaaacctatgcataagaaaccaaaaaataattcatcattttcagcatcttcaataatcttatctatcaaaggtttatttctctttcttccaagatttggaggataattttttatctaattcttcatagtcatctataatccctttatattttataagagcttattaaaagccatatccctaagcctattaaacatccagcccagcatcaccaaatatcattccaatcccaagacctaagacagtaaatccaaaagttatcatccttctaatcttctttaattcagtgtaattattgactgcaaatatttctgccattttcatccccttataatcaaaaaagtaaatataatcaaaaaatatggatgtagagatttggaaagttgttttaacaactgcatcatatattttcaaatatttatgacttagagtataaataatttatgatgagggattattatggttgttgaggttttaagattaggacatagaggagacagagataagaggatatcaacccacgtagctttaaccgcaagagccttaggagcagataaaataatttttacaactgaagatgaacacgttgaaaatagtgttaaaaaagttgtagagagttggggaggaaactttgagtttgttgttgaaaaacattggagaaaatatattagagaatttaaaaaaagagggattgtagttcatctaacaatgtatggggctaatataaatgagataatgccagagattagagaaataagcagagataaagatatattagttatagttggggctgaaaaagtgccaaaggaggtttatgaattggctgattataatgtatctgttggtaaccaaccacactccgaagttgctgctttggcaatctttttagatagattgtttgagggtaaaacactttatagagattttgaagatgcaaagataaagatagtcccatcaaaagatggaaaagtagttataagagaaaagcaaaataaataatatcaaaatatattgggggatactatggaaatccaacttccagatatagaggaaataaagttagaggatgttttgataaagaggaggtcagttagggaatattgctcatctccactgactttgagagaactttctcatatactatttgctgcctatggagtaactgatgaaaggggatttaaaactgttccctctgctggagcaacgtatccattggaaatttatgtaaatgtgagggatgttgttggagttgaggagggagtttataaatatattccagagaggcactcaattgttagaattttagatgaggaagtagggcacgaattagctttagcagctttaaagcagatgtttatcgccatagctccaattgttttaattatagctgctaactatgaaagaactacaagagtttatggagatagaggatttagatatgtgcatatggaggttggacatgttgctcagaatgtatatttaatggctacatctttaggtttaggaactgtatcagttggagcattttatgataatgaaataagggagattttaaagataaaagaatatcctctattattgatgccagttggtaggaagatagagtaatagtgtctttcaaaaaacaaaaaataataaaagttattgagaaaaatggcaggattttcacaggtcataagtattaaataacgtgtttatatgtatgaggtcatcaatattctttattaaaaatcaaaaatttaatttctataaaagccctatgaacgcttttycctaaaggatagcgttcattaatacattatttatctcataaaagacactataaagggtggggatatgatagacactcacatacactcagatacaagaggtttagaggatttggagttaatggcaatgtgcttagatggagttataacattagctcatgacccatttgagatgaagaacattaaagtttgggaagctcatgtagaaaagcttttaattaatgagttagagagggctaaaaaggttggattgaatttgtttatttgtgtagggatgcatccaagggctattcctccagagattgatgaggctttagataaaataaagagttatataaattataatagtagggttgtgggtattggagagattggtttggagaaggctacaaaggaggagaaggaggtttttataaagcagttacttttagctgaagagttaaatatgcctgcagttgtgcatacgccaagaagaaacaaggaggaggtaactaaaatcatattggatgagatttccactctgaatttgaaaaatagggatatagttattgaacactgcaataaagagacaacaaaatgggttttagatgaggagttttatgttggattgacaattcagccaggaaaattaactccattagaggctgttgagatagttaaagagtataaggactttgctgataagattctattgaatagtgattgctcctcaaacgcatcagatgttttagctgttccaagaactgttttgaagatgaagattaatggtattgaaaaagatgttatttataaggttgctcataaaaatgctgtgaatttgtttggattggacatataacaaaaaccaaaaattaattttaaaaatcaataaaaaattttattaataaaaataatagttaggactctccgtatatttaattttactcacaaaaaataaacagttttaaacggcgatattatggcatactggctttgtataacaaatgaagataattggaaggtaataaaagacaagaagatttggggagtggctgaaaggcataaaaacactataaataaagttaaagttggagataaactaattatttatgagattcagagaagtgggaaagattataaaccaccatacataagaggagtttatgaagttgtttcagaggtttataaagatagttcaaaaatctttaagccaactccaagaaaccctaatgagaaattcccatatagggttaaattaaaagaagttaaagtttttgtgccaccaattaactttaaggatttaattccaaagttgaaattcataacaaacaaaaagaagtggagtgggcatttgatgggaaaagcaatgagagaaattccagaagaggattataagttgattattgaagctaaagcttaaaacctattttttatccttgcatcaagctcatctaatgaataaacacttaactctccagtttttacagcttctattgccttaacagcagcttttgctccagggattgtagttatataaggaatacccaaatccactgctgcccttcttatataatacccgtctgactttgccttctttccagaggaagtgtttattattaagtgcatcttaccatctctcattaactttaggatgttatcatttggactttcagatatcttcttaacaagtattgctggaattccattttctctcaacactttagcagttccttctgttgcgtatattgtaaagccaagctcatgcaactttttagcaacatctacgatatgcttcttatccctatctctaacacttataaagacatttccaacgattggcaattccatatttgcagataactgagctttatagtatgccctaccaaagtctttatctattccaatagcctctccagtagatttcatctcaggccctaaaacagggtctactccaggcaatttttggaatgggaatactgcctctttaattgatacatacttcggctttgcaatccaaaccttctcagcaactttttcaacatcataatctttaattaactcctccaactttttgccgagcataatctttgtggctaacttagccaatggaattccaactgatttactcacataaggaacagttcttgaagcccttgggtttgcttccaaaacataaacaactccatctttaactgcatactgcacgtttaaaagccccactatgtttaaagcccttgctaatttggcagtgtaatctataacagtatcaattatctcctttggtaaagtttgaggaggaataactgttgctgaatctccactatgcactccagcctcttcaatatgctccattattgccccaattaaaacactctctccatcacaaacagcatcaacatccaactcaatagcatcttctaaaaatttatcaatcaacactggatgctcctctgaaactttaactgcctcttccatatactcaattaactcatcctcgctataaacaatttgcattgcccttcctcctaaaacataggaaggcctaactaaaacaggataaccaattcttttagctatctccaatgcctcttcttttgtatatgctgttcctccttcagcttgaggaatatttaacttctttaaaagttttgaaaactcttctctatcctcagcagcatttatattctctggagtggttcctaagatattaactcccgcattttttaatttcatggctaagtttattgctgtttgcccaccaaattgaactataactcccaaaagctctcctttctccttttctctttcagcaatatttaatacctcttcaaaggttattggttcaaaataaagcttgtctgatgtatcatagtcggttgaaactgtctctgggttgttatttatgattatagcttcaattcccatttcctttaaagctaaaactgcatgaacacttgaataatcaaattctatcccctgaccaatccttatcggcccagaaccgatgattataactttttttctatctgatggattgctttcatcttgctccttataaacaaatgtctcataggcagagtaatagtatggggtttttgcctcaaactcagcagcacaggtatctaccattttgtataaaggaatgatattgagcttctttctcaagtccctaacttctatctcatccattcctaataaattagctatctgtttatcagagaatcccaatttttttgctttcaataatatttcctttaatttttccatatccatataatcacctattttttattttcaatatcttttaaaactatctcaacttctttctttattttaggaacgtcttctttaactatcttccaaagaaggatataatcaatcccaaaatatttatgaattaaatatttcttaatcctaccatctctttccatgggacgttgggaaacttttccctaaaatcattatttatgtatcttgacgcttctccaataatttctaaggctctaataaccgcatatcgtatcattttattatttataaactcattatagtcaatatctttagtaaattcaataacatcattagcactttctaaaatatcatataggaatgctttaacatccctcttagacataaattaaatcctcctcaatagatttttttacataaggattgtggattgatttttttgtaattaaatcaacttttaatcccaaaatcttttctaaatattcaattagctccaaatactctgaaaatgaaggatagttgttttcatcaaattcaaccataatgtctatatcactttcttctgtctgctcccctcttgcataactaccaaataaggcaatagatttaaccttatatttatctttaaggatttttttatgctttcttaggatttcttttatttcggagagtgttttcatggtttcacactatatactatatttcttattcttctttaaccctctttaatgccaataatccattaattacacatataattccaactaaagttaccaatattcttccagttattaaagccaataatgttaatgctacaaatataagattcatcaaaattaatatatttattttggtttcttttttcataatttcccattaagcattcaatttcttaatttcttcttttaatttctccaattccttcttcatatctacaatattcttaatcttcttaatgaaaaattcatcaatatccgttagctcaactattttctcaacactccaacccttctctaacgccttagcaataacaaaaattctttcatcagttggattctttaatatttcttctatctcttcatccgtatagtctttatcctttccatctccaattatgccgaatcttccaatgtctaaacttctaattgccttttgcaaagcttcttcaaagcttctacctatagccataacctctccagtggacttcatacttgttcctaattttttatctactgttttaaacttatcaaatggccatcttgggatttttacaacaacataatctaaagttggctcaaagcttgctggtgtttcctttgtaacatcatttaatatctcatctaatgttttaccgatggctattttagcggcaatccttgctattggataacctgtagctttacttgccagggcagagcttcttgagacccttggattcacttcaataactctatattcagtcatctccttatttacagcaaattgtatattacaacctccctcaattcccaaatgtcttataatctttatagcagcgtttcttagcttttgataaaactcatctggtagagtttggataggtgagacaacaatactctctccagtgtgtattcccattgggtctatgttctccataccacagacaatgatgcaagtgtcttttctatctctcataacctcaagctcaaattccttccatcctaaaacactctcatcaatcaaaacttggttgattatagaatattttaatccttttgaggtaatatctattaactcctctttgttatgggcaattcctcctccagttcctcctaaggtaaatgcaggtcttacaatgactggatagccaatttcctcagcaaactcaactgcttcatcaacagaattaacggccttacactttgtaactggctcattaatttcagccattgcctcggcaaaaagttctctatcctcagctatttcaatagttctaatattagagccgagaagcttaattccatatttatctaaaatccctcttctatgtaattctaaagctaagttaagacctgtttgtcctcccattgttggtaaaatagcatctggcctctctttctcaataatcttctcaacgattgttggatgtaatggctctaaataaaccttatctgccatgtctgtatctgtttgaatagttgcaggatttgaattcactaaaatagtataaattccctcttccttcaaagctttacatgcttgagaacctgaaaaatcgaactctgcagcttgtccaataactatcggtccagaaccaaaaaccattacttttttaatactctccatcaatatccaccacaataatattttacaatatttatatatttaactattattattcagattatcttaatattgaggatgagcttttaaaattgcataactatatttatgttacttaactttaagtatccttttcctaataatcagttaaggtttttaaagttaatggtaggtaaatggtgataatgtggaagagaagatattgccaattgcattaagaaatgccataaaatacaatggaaaagctaatccaaaggcagttttagggatatttttgtcagaaaatccagaatataggagtaaagcaaaggaggtaatgccaattgttgagaaagttgttgaagaagttaataaactatcattggatgaaattaagaaaaagttggaagaattaggagaagatgttaaaaagaaagaaaaaaaggagaaaggtttagaattaccaaacgttaaagataaggtagttatgagattcgctcctaatccatcagggcctttacatatagggcatgcaagagcagcagttttaaatgactactttgttaaaaaatatggtggaaagttaattttaagattagaggatacagacccaaagagagttctgccagaagcttatgacatgattaaagaagatttggattggctgggggttaaagttgatgaagtggttatacaatcagatagaatagagctttattatgaatatggtagaaaattgattgaaatgggacatgcttatgtttgtgactgcaatccagaagaatttagggaattgagaaataaaggagttccatgtaagtgtagagatagagccattgaggataacttagagctttgggaaaagatgctgaatggagaacttgaaaatgtagctgttagattaaaaacagacataaaacacaaaaacccatcaattagggactttccaatattcagagttgaaaaaactccacatccaagaactggagataaatactgtgtatatcctttaatgaacttctctgttccagttgatgatcatcttttaggaatgactcatgttttgagaggaaaagaccacattgtaaatactgagaagcaagcttatatttacaaatactttggttgggaaatgccagaattcatccactatgggattttgaagatagaggacattgttttaagcacttcatcaatgtataaaggaattaaagaaggtctctatagtggatgggatgacgttagattaggaactttaagagctttaagaagaagagggattaaaccagaggcaatatatgagataatgaaaagaattggaattaaacaggcagatgttaagttttcttgggagaatttatatgcaataaataaggagcttattgataaagatgcaaggagattcttctttgtctggaatccaaagaaacttattatcgaaggggcagagaaaaaggtcttaaaacttagaatgcatccagatagaccagaatttggagagagggagttaatatttgatggagaggtttatgttgttggagatgagttggaagagaataagatgtatagattgatggagttatttaacatagttgttgaaaaagttgatgatatagcattagctaaatatcactcagatgactttaaaatagcaaggaagaacaaagctaagattatacactggattcctgtaaaggatagtgtaaaggttaaagttttaatgcctgatggagagataaaggaaggctttgctgaaaaagattttgctaaagtagaggttgatgatattatccaatttgagaggtttggatttgttagaatagataaaaaagataatgatggattcgtatgttgctatgcacatagataaaaataatttttttattttttagattttaatttcctaatctctttaatttttttagctaaaagttcattatcttcattttcaacttttttaaccctttttatcttatcctcttcttcccatttttttccagtgtatctcttagctataacataaacctcagcactttcttttcttgaagcttgaggttttgtaatataaaccttttcaaagtattttttaactaaatttacataatcatctatcatgtctccataaaataccttagctacaaaattgcctctctcttttagcatctcagtagctatttgtaaggcagtagttactaaatctattgaacgagcgtggtctatatcccaataaccgcttatattaggggaggcgtcacttataaccacatccacctttttttcatcatttggaattagctctctaattttgttcaaattttcttctaaggtgaaatctccttttattgcaactacattatcatattcaaatggcttaactggttgtaagtcaataccaataacaaagcctttatctcctacaatctctcttgccacttgcatccatccgcctggagcacaacccaaatccaaaactatctttcctggtttaataacgttaaatttttcatttaactgcatgagtttaaaagatgctcttgaacgatatttaagttttttagctaatttgtagtagaaatctctctttctttgtaaaacccatcttttatcttttcttcccatagtttcaccacaaattttaaaaatattaaatgtaatttttaaagaaataataggtaataaaataaacttaggaaaagctgattcttatgagtttgtgtaaggatagtatttacatcctaatgtcaaatttatactcaaagggaatggcatatctattttattttataactgcatttttattgggaactgaagcatttggtatcttaaagggattaatgccaatagctgacactctaacaatatttttctcttctggtattcctccagccatagcaaaattcttagctgaagaaaaagaggtagatattaacaaatatattccaatattatatttaatgattttgctctcagttgttggatttatcttaactccttatataaaatacattttaggagggcattatttaaatctgccaaatattttgtattttgcagtaggtctttgtgttgtagcttcaacagtaatagcattttcaagaggtattttacaaggattgttaaagatgaaatatctctcccttacgtggattgttgaatacactgcaaaagtcatattggtttttattctaactctatatttgggaatctttggctctttgttatcaatatctttggcatatttagtaggagggatttttgggctatatttgatttataaggcattaaaaggaaaatttgatttcaaaaaattaattgacataaaaaatacaacaaaaaacatattctctaattttaacttagacattttgagatattcaatccctattgctttaacgtcatcatcatacagattgtttggagatattgataatatagttataatgtccattatgggaggattttggagtgggatttatggttactcctctcnaatatcaagaggaatatttatgtttgcttcagctgttagcatccctttacttccaagaatatctaaaactaaagatttaagcttattaaaagaaggaattatccaaaacactatcttctcatcaatttttgttattggttgtttgtttttccctgaaatcccattgatagcattttttaaaacagctaatccagaaggaattttatgcctaagaattttagcaatctcttctttatttatgagctattatactttaatatcctctgcacttcaaggtttagggtatgcaaaaatttctttctatataatattgtttgggttggtgttaaatattatcttaaatttaattttggtaaatgcttatggaattgttggaggaagcttagctacattaataacatcaatatctgtctttttaattggtgtttttgctattttaagaataaaaaagcatattatttaattagctgatacttatactttccatttaaaagctcaactttcagtcctaatcttgctggaataacctctattccagtattttgggaaatatattctgcctctatttgaggatttgtcatcttaactcccatgtgattcattatcaacaactctggctttttgttcattgagtttattaaatcaatggcatcgttagagcagagatgccctttaattcgctcatttttctttctaacaatattcgctattaaaattctaactccatcaaagtcttcaattagctgagggataaattcagtatctgaagtgtaaccaatatctccataaattgttgatagtctaaatccaataccaaacgggtctccatgttttgtatgtgttgcctttattgttgtatcatacaactctgcagagtctccagggtataaaactctaacctcttcaagctttgattgatggtattttgatacaacatactcatattctccaaaaccttcaacaactgataagctacctaaaaaaactcctcgcttttttgtcattccttgagttatagcttcaacaataatttctccatcagtgtagtggtctggatggcagtgagatataaacagggcattagttctccatggagatatttttagctcgtttaatctcactatcgctcccgggccaggatctacatgcattctaagctcatttgtatggattctaaaccctcctgttgcctttttttgtgttattgttgcccatcttccaccaccacatcccaaaaaaataatttccaccctcaaaataccacatctccttttttgtgtttgaactgtaaattatatattaagccaaaattattaaatctttttatcttacttccttacactctacattgtatgttccatttacagatagttttatatatggataagttacaaccattgctgcaaattcttttggaggaataactttataatagacagtaattttattggcagtttctgttatatttattatctttattttatatccagcggttggcatctcttccaagtttatgactattatagttttgttatctttgtagtaataataatatcccctatttttctctccaaaagctccataggcaattatttcataatttaaagtgtttaaaatattggtattattatttacaattttatcactgacattttggatagtttgatttttggaaacatttgagtttatacatgaattattttttatattataattgcctatttgggttttttcaaaagagatacaaccacataaagttatagaacaaagaatagcagtaaatagaaacaatataattattttctttttcattttccaaacctccgctgtcttctttggtaatctctaaccgcccttagaaaatccactcttctaaataacggccaatatatatcacaaaaatacagctctgaataagagctctgccaaattaaaaaattactaattctttcctccccagaagttctgataatcaaatcaggatttggaaatggcaaatttgctgtgtataaatgtttatctattaactctttatcaatatcttctggttctatttctcctcttttaaccttttcagctatcttttttacagcatctattatttcttgctgtcctccataagctattgcaatattaacaaaaaatttgttgtagttttttgttctctcttcagcgtattttattgctttttgaacattttttggcaatagattaattctaccaattgctctaactctaacttcatatctatgaatttcttcatcatctgcaatctcgtaaaactttttttcaaataattccattaatttatcaacttcttccttaggtcttctaaaattttcagtagaaaaggcatatagagtaacaacatttatgcccaaatcccttgcccatcttaagacttctctaaccttctcagcccccaagtaatgcccgtagtatctatcttttccataaatctctgcagcccttctatttccatccattattatagctacatgttttggtaaattgtctttatcaatagcctcttctaaaatcttctcgtaaatttttaaaactccggagttgtctaaaaatctataaaaatcaattattactctttttccaatactctttaatttgttttttatcttacccaaaatccccacctattaggaatttaatagcgttatagtatctctcccaattagcgtttctacttgtatcaataaaattgacatttttatctgataaaataactgccccataaccaggaattttgcaaatcaaacctaaacatctgaaaattaaatttccagtaattccatctacagctataataatattgtatccatcttttaaatattcctctattaatataccattatgtataatatccacatttcctttaaaatgctcaactatttcctcagcttcatatattgtttcatccactactttattccttcctaaatctcctaatcttcctccagaaaggactgcaacttttgctttaatattataattttttaaaaagttagatgcaaattctataatccttattttatcttttattctctcatttttgtcttctgatatatcatcaatccctactggagatagtaaaaagattccattagtaaagggattctttaaaattgatgccctataaaattttcctattctttctcttaaatagagaattacttttgatgaagataaagatcccctaacagccccatctatctctccatccaatagtttatctactaaaagttttggattgtcaattaattcaacctctattccttcttcttttaatttttcataagccttcaaaacttcttctttattgtctcctatgcctatagcatacataattatcacttaaactccacttctattcctaaaatatctctcttcccttttaaaatatcctctgctatcaaagcccccccaatagccccactttctccatataagacaaatatctttgcctcaacaaactctttaattctttttggaatatctatcggattccttaaagtccctatagaacctgctaaaaccactcttcttttatttttatccaataaaggtaataagctatttatctccatagagacacttaaaattaagctatcaactgccaatctacaattttcatcattaaaatagttgttaattatctcttcttttgtattttcaacacctttatagagcttggctattttaacagcccctgcctttgaaaatgcttcatttgctgtaatttttccagcatctatatctctaatcatttctaaatctatagggccatgtaacattccaatagctccaatacacgcatcaaatcctccaaaaatcttaccatcttttattaataaagttacagtatttgaggatatatcggataaaacaaaatcattaaatccaaataatttatatgcataataagctatagaaaccttttctggagatgctatatgggagtataaagctctaaacctctcatctaagcattctattcctctatgcaatcctggaataacaacagctggcaatccagattctttaatctcatcataaacctttgttcctcctccaaccttttctccagctccttcaatacttaaaactcctctatttttcactttttctattggtaggattttgtttatcccatctcccattgagtaagttaaagcaatcaaatcaatatcttccaatgaaatatgtttctccaactcctctaagtaagatttttctttgagttctgttctctttagtttaaatattatctttttatcattatcttttatgcatgtagttattcccgacgttccatggtctattccaacggttatcatagtttcaccaataatttatgcaattctctttattttatagaaatcattccaaatttcttttgaaaggcttttaaaatttcattaaaatcatgatgttcaagttctcccaaaccatatccatcaatataatcttgtatttttataaatctttttattacagcctcttttgagaaaattattactgaaaatgatactctccaagggaaagtaactttatttaagtttatttcattgtcccatattggtgtttggtcatcataatatgtctcttttataactccaatagcatgaatctctccggtttttgcaatttggaaaacggcaacatcaaaaggttttatttggttatattttcttataaaacttctccaattctttttctgtttctctccagcgtttctatcccaaaatccccaaatcatatgattatagcagatttcaatatttcttatattgttagagctaaagagccaatatgtcataactatatccctcattttaataaatttttaatgaaaatattatactatcaaatgtcatcaattttgtttaacacaaattttatataattaggtaatttaattaccttaaaaatgattaagattgattagggataggcatggagaagttcgatattgcgatgacagtgtttttggtaatgatattcttattcatatttttaccaattatttatatgctatcaaatcccggagatttaaaccaattgttggataaagaggttatagaggcgtttaaaactactctattagctggagctgttgctactctaatagctctaatttttggaataccaactggctatattttggcaaggtatgattttaaatttaaaagctttgttgaggctgttttagatttaccgatggcaattcctcacagcgttataggtatcataatcctatccttcatttatggtattgatattataaattttattggtagatatgtagttgataacttttgggggattgttactgtctatctatttgttggcataccttttatggttaatagtataagagatggctttttaagtgttgatgaagagattgagtatgtctcaagaaccttgggggcttcaaagataaggacgttttttgaaatatctctcccattgataaaaaataatatcatctctgggattattttgagttttgcaagaggaattagtgaggttggagcaatattgataatagcatattatccaaaaacagttcctatcttaatatatgaaagatttatgagctttggattagatgcttcaaaaccaatatctgttggaatgattttgattagcatagcgttgtttgcattactaaggatgtttgggaggatgagagggagataatgcttaaagtaaataatctatcaaagatttggaaagattttaaattaaagaatgtctcttttgaaatagatagggagtattgtgtaattctcggtccaagtggagctggaaaatctgttttaataaaatgcatagctgggatattaaaaccagattctggtagaattattttaaatggagaagatataacaaatctaccaccagaaaaaaggaatgttggttatgttccacaaaattatgccctatttccaaacaaaaacgtttataaaaacattgcctatggtttaataataaaaaaagtcaataaattagagattgatagaaaggttaaagagatagctgagtttttaaatatttcacatttattaaatagggatgttaaaacattaagtggaggagaacagcagagggtagctttagcaagggctttaattctaaatccatctattttacttttagatgaaccaacatctgctgtagatattaagattaaagaaagcattatatctgaattaaaaaagataaagcatatcccagttttacatataacccatgatttggctgaagcaaggactttgggagaaaaagtaggcatttttatgaatggcgagcttatagcttttggagataaaagtatattaaaaaaacctaagaataaaaaggttgctgagtttttagggtttaatataatagacgataaggcaatagctccagaggatgtaattattaaggatggaaatggaggagaggttgtaaatatcatagattatggaaaatataaaaaggtgtttgtcaaatataatggttacatcattaaagcttttacagaaagagatttaaatattggagataatgttggattagagtttagagaacaaacaaaattaacatgaaattttttggtgataagatgattgtagtatcaggaagtcaatcccaaaatttggcttttaaggtagctaagcttttaaacacaaaattaacaagagtagagtataaaagattcccagacaacgagatttatgttagaatagttgatgaaatcaacgacgatgaggcagttataataaacacacaaaaaaatcaaaatgatgcaattgtagagacaattttgctgtgtgatgctttaagggatgaaggagttaaaaaaataaccttagttgctccatacttagcttatgcaaggcaagataaaaaattcaatcctggagaggcaataagcattagagctttagcaaaaatctactcaaatattgttgataaactcattacaataaatccacacgaaacacacataaaggatttcttcacaatcccatttatttatggagatgcagttccaaagttggcagagtatgttaaagataaattaaacgacccaatagttttagctccagataaaggagctttagaatttgctaaaactgcatctaaaatcctaaatgcagaatacgactacttagaaaaaacaagactctctccaacagaaatccaaatagctccaaagacattggatgctaaagatagggatgtgtttattgttgatgatatcatctctacaggaggaacaatggctacagctgttaagttattaaaagagcagggagctaaaaaaataattgctgcatgtgtgcatcctgttttaattggagatgcattaaataagctctattcagctggagttgaggaagttgtagggactgatacatatttatcagaggttagtaaggttagtgttgcagaggttattgttgatttattataatttttaaaatttttaattttttatcctaaaaacccaataaactttcctaagcaataaaatacaccaatagatgcccctaaatttgagagagtggcaactaacaagactctaaataaattgttgtttaagagctctttaattgattcagcatttattattcccactaaatctttatctgttatctctctatactttaactctacaagtccagctatcgtccccacagccgctaatggtaatgggacgagagtagttataggggctgatagaaaggcaactaatgcagttatcaacttccctcttgccaataaaactcccaaggcagataagcccccagtaaataatatccattgaaaagtaatcatctttaataattctggattatttagggcgtaacatatcatatacaaaaagatgctaattatagtcaatgaaataccatatgttaaaagcttttttaatgatttttttctcttttttacctttattaattccattaaatcaatatcatttccattttcaagcttttttaaatatcttacaattccctcaacatgtcccgctccaactactgccaccaaagaatttttattcttactcaattcaaataaccttttagccatgaatctatctctttcatctactaagacctcatatattgttggagatatctcctttagcaatttaataaatttttcaggatttttaaccatatcgtttaataaatcatcatctaattccaaatcttcctcatcagaatttaatagctcccaaaaaatcttcattttttctttaaatgtcattctatccattaatcttgataaagtgatatctatatccctatcaattagatatattggcaatccatatttgcttgctatttctatagcttttttcatctcactacctggctttattccaaaactctcccctatcttcttttgagaattagctaaaattaaatatatgaaaaattttaaaaaattcccttcctttaatactttttttaaatccacttttttctcttcatttgtaattaatgagaaaaatcttctatcatcaagctctactgcaattccttctggagagacagatgatataattttttctacttcttcaatactatcctttgaaacatgagcagttccaattaaatagatatcacattcattaactccattaaatactctaacatgtctcaaaataatcaccatctatttgtaaaaagtgtcgttgatatttttgtagaaattattattaaattgtgcctttaaatatttaacactaactattaattgtttaatttatctttttctttttttagtttttacacctaagaaagccctttttattataattgttgcataacttcctttttccaattcatagcttaaagttattttatattttcctttattcaattcatcctcttcaaactctccaatttttaagtttttagggattgaaagaatctttctttcactgtatatgaacttccctaactctcctatattatttagctcttccatagtaaggccttctctctttaagatttcttcaataatttctttttcttctccactatattcaatgtctggagctattgttggaaattttttatctttcaatatattaaacacttcctcatccatttttttatagaacataagggttccacattcatattcataataaaccctatcttcttctggaacatattttcttaataactcttttacacactcattccatagatagctttgataagcagcaacaaaaattttcttcagcctatcatcaacataacttaaagcttttttataatcattgctttttttaagctctttaaccatattcacatataatcttgactttatattattttccttaatatactcccaaattttatcccaatctccccagtttttatctataaatctctttaaatcttttattaatttcttttcagattttttatatttcgttagcaatattttcacagcttcttcataattgccttttataacttctttggcaatgaattttttatcaaaaacgcttccaaatctctgactatcaaaataatttggagctccaaattctaagtattttaaattttcttttatttttgggatgtcttctttttttaaacccctaactgttattgtgaatctatttccctctaaatctcccaacaatagaaattttgattctccgattaactctaattttaaatttggttcatctaagcttaattttccatatttttttggtatagatatatattgagtagttaaagcatgcctatcttttaatccacagtatccaatatccttcaatggaattttaaatttttttgcaatataagagaatgctttcaaactctctatatttctctttgttaatttataaaggtagcatctatctccagctattttattaaaatcaataatttcttcaacgataaaatcctctggcttcattctaagtttcataaaagcaccccaacaatataaacttctattattaaacttaaatttaaaaaaagactctttggttgaaatatttttcataaaaagacttgaaaattcacaggaattagttccacagaaaaaataacctaaaggaatttttaactttcttgggtaattttttaactctaaaatagatgacgcgggggccgggacttgaacccgggctgggcgttgcccaatgggattagcagtcccacgccgtaccaggctgggccacccccgcaataaaagcaaacactaattgggtataaggtatatatatagttttcgtttttacaatacaagatatagaaaattaaaaactatttcgaaccctaaaacatacaaaataaaaacaaactcataaattctcttaaaaataaaactttaaaattgaaaaattagtaatactttttattaattttccaataccaaaatcaaacaacctacttataatcttaaaaatccgaaagatttctaaaacctgttcgctatgctcacaagaagcaagaaattaaattaaaaaatctattatgcatattaaaattctcaataaagcataatctatttatattttatacatcactatttgtcattaatgataatgataaattactggtgacagtgatgattaaaaaaatcgcaaggaagaagtgtattcatgtaatgcttgtttatactggtggatgtaacgcttgtgatattgaagttgttaatgctatattctctccattttatgatgctgagcagtataatgtttttttaacatttaatccaagagaggcagatattttagttgttactggttgtgttactaaagttgttgcagaatcattaagaaaaatttatgagaagattccagaaccaaaggcagttgttgctgtaggagcttgcgcattgatgggaggagtttataaaaacattggaggagatttaggaacttcagattttgttgcaggacctgttgaaaacattattccagttgatgttaaagtgcctggctgtgccccaagaccagaggatattattgctgggatagttaaagctctacctaaggttatcgaaggaaaatgaggtttttataaaattttatgagtgagaatgatttatgtttgtaaaatttctttagtgagggataggttatgattgatgagctaatatccataattggcattccggctttagcatttgcaatctctacatatattccgggaattcagagaaagatagaggcaaggatacaacaaagaatagggccgagtatattagccccaggattttgggcattttttaagtttttatttaaagagacaaaagctcctgatgcaaatttgccaaaactatataatttgctgcctttgttgtctatagttgtgttgtgggcattgttgtctataacatcattaacatccttccatatattatctaacgagattggtattgttggattgctgaagttggaggagatgatgtatgttatattaggttctttagcattttcaattatgggctggaaaatgccgtttatagatgaatgcaaaggcacaccgtttataaaaactttaaagctttcattggagcagttaggagctgtaagaagctttaaaatgataactataggttcatttccattttatttagcaacatttttgccatttgttcaaaagaagagtatattcttaaaagatattgttggagaaccatttttattctcattggctgggatatttggagctgcgtgttatttcattggatatgtgataatgattaaagaatatccattctcaataactcacacaaaggcagatgttattgaaggtcctacaatggaattaattgcaaaatatagagctttatatttagcaagtaaggaacttttgttaatagctttaggaagtttatttgcaactctatacttaggaatagctccagatatagagaatcctataacaatagttgaaaactttgctatagctttgatattccctatattggccacatttgttagggcattttcgccagtacttttatttaaacagatatatcctatctcctatgtggcaacactaattggtgttattggctttatatttgcattgcttggatggtaaagtatttcagaaaatatctaatgagttatgagaaaatgcttaaaacagcaataataattattttaaaaattatctttgagattctggtttatactcttccttaattttaacaactactactggagtatgctccaatttttccaaaatctcttcagttataacataggtgttgtatttttctaaaacttcattaatgttttttattgttttatgcactctatcacaaataaaagctatccttgtaagctcaccaatagaatactttttatatacctcatttccagctattgctaatggtgtgcatccagcaaatccaccaatctttaaaacatctgccaaccttccaagaatgaaaccaaaaactccaataccacttattattccatcaattgcatagggaagagcggtaaaatagaaattcaaaactctataagtagcatcagtatcggcaaccataacaacaacatcaacacctaattctttttttatctctttatataactcctcagcccatttttttggattttttgggagaggacaggcataagtcccagggacgtttgttaaatcaactcctccttcagcataaggttttaaggcatatcttaatccaactatttctataattgtctgtttatgctttaaagtctcttcctttggcattcttctcaaattttttattttatcttctttaactttcaataactttccaagcacatagccccaaagatatttagaccaataatagcagagataagctaaaactcctggtttaaatttactctcatcaataaaatttccctcagcagttgaaaccatcttttcacttaatactacaaaatctccatcctctaatttaattccactattttttattgcttcaacaacaattgggataaaattttctcccctttttatgtatcttgttttgatgggataagctctcatattctcacatgttaaagtgtatcaccgtagcaatattgaataggatatttataaatatggctaattaataaattattattttgttagataaaatcaaatttaattatgtgggggagtatgccaagaaggaaaatagacaaattgtatgtaaaaatctatttcgaaggtaatgcaatagaaggtgaatatgattttgacgcagttacacacttaaaaaatggcatattaaaatacctatggactggaaaaaaagacccaataataatttggaatatggataataagtcatttaccattattgacccatcaaagatatgtgctgtagaggtacagggttcattaatgttcttagatgacatccctgaaaagaaattggaaatgaagtcatttagtgagagagattagcttccttacttaattaataattaaaaataattaaaaacaataactactaaaggtgaaaacatgaaaagagtaaaaactggaattcctgggatggatgaaatcttacacggtggaatacctgaaaggaatgttgttctattatctggagggcctggaactggaaaatccatattctgtcagcaatttttatacaagggggttgttgattacaatgaaccaagtattttagtagctttggaggaacatcctgttcaaattagagagaatatgagacagtttggatgggatattagaaagttagaggaagagggaaaatttgctataatcgatgcctttacatacggaataggaagtgctgcaaaaagagaaaaatacgttgtaaatgacccaaatgatgagagagagttaatagacgttttaaaaactgctataaatgatattggagctaagaggataggaattgattcagtcactaccctatacataaacaagccaatgctggcaagaagaactgtctttttattaaaaagagtcatctctggtttaggatgtactgctatcttcacttctcaaatatccgttggagaaagaggatttggaggaccaggagttgagcatgcagttgatgggattataagattagatttggatgaaattgatggagagttgaagaggagtttaatcgtatggaagatgaggggaacaagccattcattaaagaggcatccatttgacataaccaatgagggaataattgtatatccagataaggtattgaagcttagataaaattttaagggagaggatggagtcatttatcttaattttatcttaattttattatttttgggagtagtgtttgcttttggattttatttgatattcataaagcttactggattaaaattgatggattattttccaagatttaaagagaatagactaaaaatgatttttagtattttaagtgtgantcttgcctttctcataaattggttgattatgaaaaattttagttttttgattgagataattcatccaattgcatcagtctggatatttattatattgatatatttattattaagattcttattccttaaaagagtcccattatcaaattatgaaaagaaattcatgggaaatatgtctgcaatagccatatttcttgaacttttaaaaattatcgaatatgtggatgagcataatattgcctctccaataacagttgctttagtgttttttatcccagttgttgttttttttaattgcaagtatttttatgaaatggagttgtcaagttagcgatttcatccagttgtagaacatcatgaagctttttatccaactaacaaccattaggttttgtaaatacagcaaaaaggttatatcctattagttgttatctataaaatatggcaaaataggggggctggtagttatggagataaacaacttttacatcggctttattggattagcagtatttatttttgctattactattatgttctatatttgggcttttaagtttgataaaaagtatttggctaaggagtagtagaaccatcttttttaatccttaaaaccaaaaattaataattaaaagattatcatgtgaaaccatggagacgtcaaagaagttagttattgttgcagttctctcaataacattaattttaacttatgcctatttaataagcataattgagggggttgattatttcacagctctatatttcagtgttattacaataacaaccacaggttatggagattttactccaaaaacatttttggggaggacattaactgtagtttacctatgtgttggtgtgggaatagtgatgtatctcttcagcttaatagcggagttcattgttgaggggaagtttgaagagtttgtgaggttgaaaaagatgaaaaataagattaaaactttaaaagaccattatattatctgtggatatggaagattagggaaggttgtgggggagaagtttattgaagagaatatcccatttattgctatagatattaatgaagatgtcctaaaggaagagtatgaaaaatacccagataagtttttatacattgtgggggatgctaaaaaggaggaagtattgaaaaaagcaaaaattgataaggcaaagggattaattgctactcttccttctgatgcagataatgtgtttttaaccttaacagcaagagaattaaatccaaacattttaattactgctaaagcagatgagaaggaagccataagaaaattaaaaatagctggggctaatagagtagtgtctccgtatttaattggcggattaagaatggctgaggtctctgttagaccagggattttggactttttgagcacatttattaagatagctaaagatgaatatgaggaagatattgagttgagaaagtttgtcattgaaaaagattctgaattagcatataaaagtttaaaagatgcgaatattagaggaaaaactggggctacaatcttaggtattcgaagagaaaaggagttttgtataaatccttatccagagtttattctaaaacctggtgatgtaatatatgcatttggaactgaagaaaacttaaaatatttggaaaatcttgttaaaaagaaaaagaaaaagttataatcccatcttttttattcccaatttaacggcattcttttttaggttttggtttatcccaatataatctaaaaccttgctctcaaagttcatgtatgcagcaacatttaacaatataaccctcttcaataaatcgtctaaaatatcaacaatctcctgggcatcttcttttaattcctcttttaatttatttttcaatctgtcttcaattttaataattattgcagttaaatactctggtaggaaatctttctctacgtatttaattcctctttttacaatttctttataaaattcatttaaatcactatcattggatatttcaaataaaccctttatccaatttttaaaatcttcctcaagttcctttcttttactctcatcaaataatgtctttgttttttcatatgagaagatatcattaaatacctcttcaaccacttcgtctattgtcttactaattaagtccttatattgtgtcaatttagaaaaatccttctcttcagatgcaaagtgatgcatattttcaataatttcgttgtatattccatcgaatgttacgttcattactaccccctcctctatgttaatttttaatttgaattatgggtatatacaaatatagtgttattttattgtttaatattattacttatttagtttagtctggagttttttaaataaaaaattaagaataataagtttctatttaactgcatctactaaaaatatgatttagaaatggtataaatacttattggttattggtagaagtttagataagcttctaccaatttaactccagcgtctgttaatcccttcttccctatgaatccaacattctttaatataaccaagttctttttaatctcctctggggttaaagatagatacttagctaacaatacaatttcattttctttatgttctttaccctcactcttctctttccaaactttatcaaactcttctttatggtcatagatggtttttaatatgttgaatgttgttggagttacagcaaactttgttgccaacaattcttggattttcgccatttctatagctgttttaacctcttcccctaattctgttaatttaatcatcttgttttgcaactctttaatgaatcctttggattctgcctcacctaaagatttaatgatttctttctcatctccaccaacatgaccttggattaacttaactaattcatctctgtggatatatctctttcttggaatcttaattagagttgagatatcatattttgttaagtatggctttcttttaattgtttttgataattttattaagtattttcctttttctgttattcctctttttacagttccttcttctttacctttaattacccattcagcaattggcacatctccactttctggataggttatagctttcattccatctgttgatacctctcctaaatctttaaccttctctccaaactctgtcatccaatatgtgtctttatttttaacaacttctctctttattaactcttttgattctaaggtgtgtaatacagcccctaagtcatcaatatttgttctctttttaatttcatcgtaagttggtataatttcagggtttgtttcatacttttcctttatttcttcaattgcctttaaaaccttaatctcatcctctaagacatagattgggagggttttctcctcaaccttacccatctctttataagtgtccatcattgcttgtcctaattcagtaacttttccttcagcatagaaaccgctttctgtcatctcttcagtagtttctcctctctccaaaatttcaaagtcctcttttctcaatattaaagccctacttaagtttggaactaatgaagctacttttaaaacatagttcaatgcctttgttgtagaaaatgcctttccactttctgtttttggtgaaattaaaagcaatctcatagcttggagtgcattaattatgttatctccatattctttagtgtttttgtaagttattagctcatcataaactccaatctttggcatatcttttataaatgccaataattcaggagttagataaacaactggatgtgtctctctatatatctttaaaatctcttttccaatctctgttaaaccattttcatctgctaagaatctctcttttaacattaacatccagtcctctggaacatttccagtttcctccaacaattccataattttaataatctcagaatctacaaatatatctggaatcttttctaaatcaattttatcaacaatctccatcaattttttaccagcttcagtgaatattatcttatctccttttaattcagcaaatcctaatataaacagctctaaagctcttgttttaaactcttctggtagagctttttctatctcgttctgcatttctgtctctttcatcttttttaatatttccaagtgtctcttttttaggaacacgatatcacctcatcactatttattattatttttgtatttatttttattgtgttgtaagttcttcaataaatgctttattgaattcttttattgctctaaatctaagaatccacaacattatcataaaaactgttgctccaaagaatgtaacccatacaagcaggctaagatttggcaccaaatataacgttaaagttactaagaacaaaattgaatatccaacatcaattacatacctgtatttttccatctcaaagagaaatatagaagttagtgtgaatgttgttattttctctaaggtatttgttaaatgacttttatttattattttattttcaagttctttcacatcttcccctttttcataggctttgctaatctttcttattatttcatatcctataagaatatggcctccaatccctaaaaatactaaaaaacccatggctgagagaattccaagtattattcctacatccattattttcccctatcatattttgttctaatattgctaatttatattcattttttactaattaaagttctcacttttttatgtctatgaagttctataaaaacttttctataatcaattaatttaaatatgtttagaaatttataaacataaaaattaaaaaataggataaaaatttacagtttttaaactgatatagcacccgccaccctgcgaacccaatataaataatacaagggagcaggtggcgaaaaaagacccgaagcatgcacaaaaataaaaatttaaaagaattaggtgaaaccatggaatttaagattgtaaatactatctgcccttattgtggagtaggttgtggtttggggttggtagttaaagatggcagagtcataggtattcatcctaacaaaagacatccaataaatgaaggaaagttatgtgctaaaggaaattattgctatcagtttatacacagtaaggatagattaacaaaaccattgataaaaaaagaaagtggttttgttgaaactacatggaataaagctttagaagtaattgcagaaaatttaaagacctataaggatgagattggctttttttcatctgcaagatgcactaacgaagataactacattttacaaaaatttgcaagggttgctttaaagacaaacaatattgaccattgtgcaaggttgtgacattcagcaactgttactggaatgagtgcatgcttcgggtccggtgctatgacaaacagcatagaggatattgaattagcagattgtatattgataattggctcaaacacctttgaacaacacccattaatcgcaagaagaataatgagagccaaagataaaggagcaaaaataatagttatagacccaagaagaacaataactgcaaaaaactctgatatatatctacaaataattcctggaactaatgttgccttaataaacgccatgattaatgtaattataaaagaaaatttgatagataaagaattcataaaaaatagaacagaaggctttgagaaattaaaagaaattattaaaaaatatacaccagaatatgcatcaaaaatatgcggagttgataaagaactgataattgagagtgctaaaatttatggaaatgctgaaagggcatctatcatatactgcatgggagtaacacaatttacacacggtgttgatgctgtcaaggcattgtgtaatttagccatgataaccggaaatattggtaaagaaggaactggggttaatccattaagggggcagaataacgttcaaggagcttgtgatatgggagctttgccaaatgtatttcctgggtatcaaaaggttgaagatggctataaattatttgaagagtattggaaaactgacttgaatccaaattctggtttaacaataccagagatgatagatgaatctggaaaaaatattaaattcctatacataatgggagaaaatccaatagtatcagacccggatgttaagcatgttgaaaaggcattaaaaagcttagattttttagtagttcaagatatattcttaactgaaactgcaaaattggcagatgttgttcttccagctgcatgttgggcagagaaggatggaacttttacaaacactgaaaggagagttcaattaataagaaaagctgtaaatccacctggagaggctttagaggattggataataatcaaaaaattagctgaaaaacttggttatggagataaatttaactacaataaggtagaggatatatttaacgagattagaaaagttacgcctcaatatagaggcataacctacaaaagattaaaaattgatggcattcattggccttgtttagatgaaaatcattcaggaacaaaaatcttacataaagataagtttttaacagataacggtagaggaaagatattcccagttgagtatagagaagttgcagaactaccagataaagattatcctttcattctaacaactggaagaataatattccactaccatactggaaccatgacaagacgatgcaaaaatttagttgaagagattaatgaaccatttattgaaataaatccagatgatgccaaatcattaaaaattgagaatggtgatttagttaaggtgatttcaaggagaggagagataactgccaaagcaagaataactgaagacattaaaaaaggagttgtatttatgccattccacttcgttgaggcaaatcctaacgtattaaccaatactgcgttagatgagttgtgtaaaattccagagcttaaggtgtgtgctgtaaagattgaacgaatttaatttatagaattgtttatataataggaatcatatttcctaatgttatggggtgagagtatggaagagatagttaataagattacaaaatttatcagggagaaggttgaagaagccaatgccaatggagttgttgttggattaagtgggggtattgattcttctgttacagcttatttatgtgttaaggcacttggaaaagataaagttctcggcttaataatgccagagaagaatacaaatccaaaagatgttgaacatgcaaagatggttgctgagaatttaggaataaagtatattatctcagatataacagatatcttaaaggcatttggtgctggaggttatgtcccaacgagagagtttgataagatagcggatggaaatttaaaggcaaggattaggatgtgcatcctctattactttgcaaataaatataatttattagttgctggaacttccaataaatctgagatttatgttggatatggaacaaaacatggagacattgcttgtgatataagaccaataggcaatttatttaaaacagaggttaaaaaacttgctaaatatattggtgttccaaaggaaattattgaaaaaccaccatcagcagggctttgggaaggacagacagatgaagaggagcttgacattaagtatgaaactttagatacgatattaaagctttatgagaagggcaaaactccagaggagattcataaagagacaaacattccattggaaactattaactatgtgtttgatttaattaaaaagaatgagcataagagaactttacctccaacaccagagatttaatttttaattttagtttaaatattttattttagttattctattttaaaattaaattattttatatattgtaatattccaaatcataagtctcagaccataattatttaaatataacttcaaccaatatttagaaaacccaaaaaactatctcttttatatctctacggagggttgttcatgtgtggtattatcggttttatgagtagaaaaaaaagaatgataaaaggggataagatagcgttagcgttagatagtctaaaagagagaggtaatgggaagggttctggttatgtaggttatggaatatatccaacaaagtataaagattgctatgcattccacattttaattgacaacacaccaaagtttgagaaaataaaggtagaggttgagaatgtcttagagcagtatgggacaatagttaaagatgaggaaataccaacagaagatggcattatagaaaaaacacaaattccttggagatacttttatgaagttgatgaaaaatttgctgatagagaggaagatgttgtcgtagatatagttatggagattaatgacaaaatagatggagcttttgtcatttcaagtggtaaggatttaggtgtttttaaggcagtaggatggcctgatgaggttgctaaattctatagaatagataaatatgaaggttatatgtggttagcacatgcaagatatccaacaaacacaagagcatggtggggaggagctcacccattcaatttattaaattggagtgtagtgcataatggagagataacaagctatggaacaaacaaaagatttgttgaaatgtttggttataagtgtagattattaaccgatactgaagttgttgcctatatattagatttattgatgagaaaacacaaaatccctgttgagtatgccttatctgctttagcaccaagattttgggatgaaatagataagatgccagaggaagagagagagttacatacagcaataagattggcttatggaggagctatgctaaatggtcctttcgcaatagcagttggaactcctcaaggtttaatctttatgaatggagatattgagaaagacacaacaatgtttggtttaacagatagaattaagttaagaccattaattgcagctgaaaaggatgatatgatatttatttcaagtgaagaatctgctataagaagaatctgccctgacttagatagagtttggatgcctgacgctggaatgcctgttatagcaagaccttggaaataaacaaagattaaaagattaaaaataaaaacatgaggaagtgaaatcatgattcccagctatgtgccaccaaagtataaagtagaggttgacccaaacagatgtatgctatgtgagagatgtacaatagagtgttcctggggagtttataggagggaaggagatagaattattagctactcaaacagatgtggagcttgccatagatgtgttgtaatgtgtccaagggatgcaataacaattaaagaaaatgcaatatcttggagaagccacccattatgggatgtagatgcaagggttgatatttacaatcaagcaaaaaccggctgtattttattgagtgggatgggtaatgccaaagaacacccaatctattttgataagattgttttagatgcatgccaagttacaaacccatccatcgacccattgagagagccaatggaattaagaacttacattggtaaaaaaccaaagcagttagagtttgaatttgttgaagaagagattgatggcaagaagattaaaaaagctaagttaaaaacaaaaatagctccaaacttaaagttagataccccaataatgattgcccatatgtcttatggagctttgtctttaaacgctcacctatcatttgctaaggcagttaaagaatgtggaacattcatgggaactggtgaaggaggattgccaaaagctctctacccttatgcagaccacataattacccaagttgcaagtggaagatttggagttaatgaagagtatcttatgaaaggttctgcaatagagattaaaatagggcagggagctaagcctggaattggagggcacttacctggagagaaggttacagcagaaatttcagcaacaagaatgattcctgagggaagtgatgctatctcaccagctcctcaccatgacatttactcaattgaggatttagctcaattagttagaagtttgaaagaagcaacaagatggaaaaagccagtgtttgttaaaattgcagctgtccataatgctccagctattgctgttggaatagcaacaagtgatgctgacgcagttgttatagatggatataaaggagggacaggggcagcaccaaaggtattcagagaccatgttggaatcccaatagaaatggctattgccgcagtagatcaaagattgagagaggaaggtttgagaaatgaaattagcatcatagcaagtggaggaatcagatgttcagcagatgtatttaaggctatagctttaggagcagatgctgtctatattggaactgctgcaatggttgctcttggctgtagagtttgtggaagatgttatactggattgtgtgcttggggaatagcaacacaaaggccagagttggttaagagattagacccagaagttggagcaagaagagtagctaacttaatcaaggcatggacacatgaaattaaagaactcttaggagctgctggaattaactcaattgaaagcttaagaggaaacagagataggttaagaggagttggcttaaatgagaaggagttagaagttttaggaataaaagctgctggagaataaatagaactttcacaaataaaaatactttattgaagggtgatgcctttggcatctaaattccaaaatcagcatataaactgtgaaagttctatttaaattttttaatttttaaaggtgaaaggcatggaagaggttgttatagatgcaaaggatatgcactatagagagctgaatgaaaaaatacatgaaattttaagggaaaatccagacattaaaaaaattgtcttaaaaaacgttttagggcagaggtttattgccgatggaatacagaagaaagatttaactatagagatttacggcattcctggtggagatttaggaatgtttatgagcggccctacaataatagttcatggaaatgctgaatttgctcctggaaacacgatggatgatggaacaatagttatctatggaagtagtggggatgtaaccgcccactcaatgagaggaggaaaggtttttgttagaggggatgttggttatagaagtggaattcacatgaaagcttataaagataaagttccagttcttgtgattggtggaagagctaaggatttcttaggagaatatatggctggaggtattataattgtcttaaacattgatgaaaaaggaaatgatttaggaaaggttaaaggaagaatgataggaactggaattcatggaggggcaatttatattagaggagagatagacaaagaccaattaggtgttgctgcagatataaaagaatttactgaagaggatttagaaaaaataaaaccatacattgaagaattctgcaaatggtttaatctgccagaagatgttaaaaataaactattgaattcaaaatggacaaaaatagcaccaatctcaaaaagaccattcggtaagttatatactcctgacttaatgtgaaacttttagtaaaagtttcatcaaaactcgtccattaagttagactttcagtcctaattaatgtccattattataacagtgggactgaacgcagtgaagcccactctggagtattccaataggcgaagccctatggttgcggaagctctatactccccgacttaatgtaatttaatagaaatttttatcaatttttaaaactatttagaagaaacaccaaaatgagccttaggtgagattaatgaaatcttacaaaaacctaaaagaggaagtttgggatactaatagatgtagtggttgtggagcttgtgttgcagtttgtccagtaaataacctatattttagagaagaaagcccagtaaagtttgagtgcgatgaatgttcctgtataatagtcccagcagatatcgttgagcatccaatttcagcagagttctgtaagacagtagtttatgacgtcccttgtggagcttgttacgatgcctgcccaaggataaaaaaatctgctattccaaaaccaaagggattggggaatatattaaaggcagttagagctaaagcatcaatagagataaagaatgcccaaaatggtggagttgtaacagccatattggcaaatgcgtttgatgaaggattaatagatggagccattgtaatgatggatgacaaatggactttagagccagaatcatatttggcgttatcaaaagaagatgttttaaagtctgctggtagcaaatacctatggaaaggtccaatattaaaggcgttaaaaacagcagttatggaaaagaaacttaaaaaattagctgttgttgggactccttgtgttataaacgctatctatcagatactatcatcagataacgacttattaaagccattcagagaagctataagattaaaaattgccctgttctgttttgagacttatgattacagcaagatgattaaaaagcttaatgaagatggcatagagccatgggaagttaaaaagatggatatcgaatctggtaagttaaagataaccttaatcaatggaaacactgttgaatataagcttaaagatgttgagtctgcaatgaggaatggttgcaaggtttgcggagatttcactggcttaacatcagatatttcagttggtaatgtgggaactgagaaaggctattcaacagtcttaataagaaacaagtggggagaaggattctttaagagagcagtttataatggttatataacctatgatgagaacgttgatttagaagcagttgaaaaacttgttgaattaaagaaaaagagagttaaaaaggattaaattcaactataactttttttcaataaactctttcaaaacataataatccaagatttcatttaataaatcatcattatgggcatctttataggtatttggtaatggtcgttttataatctctttatagatttcatttaacctatttagccattcttctttttttacattgccattttttaaattatatgcaatatccacaattagattaatcttatttttctcaatttcattaaattcatctaaatcaaaatattccttaaatagcataacataataaaggcatttttcataattttcttttagtagatgggcaatagccaataaatcactcattgatttgtcaaatcttttaatgatttcattgacaatctcattagatatttggcaacttttaattttatttttaaattcctcataaacttctaaaaatcttttccaatttccagcccctataaaaaacatcatcataaaatcaaagaaatctgaattgaaattatatatattatcttcaaatagttttcttaaatgaggctctctgtttaagatttcttttctttcttcatagctaaagtcaaaagttaaaacactttttaaaatatcctctgaattagcatctttaataacatcgttataaatccactctcccccactatttaaaaagttttttgtaatatctaatttcccaatctttgcaaatattgaggcaatagttgataactctccacttaaattataataatctccatctgccaaaatcccttcaacaaaccagtcgaattttttaattccttcttcaatgttgttatttaaaatttctttataagcctcttctctaagtccataataatcacattttgggacattttctttaaagattttattagataaactaaaatactctattgctttatcgtagtcctttttattataaaactcacatcctttaagccaatatttgtatagaaaatttgacgaatctttgttcataatctcccaattaagctctaaacatctcaaaataaaaaatcaacatattaaagaatcaatcttcctattcaatatactttgtcttatcttcaactccagccattaaaaaagctctcttccttctcatacagctctcacacttcccacagtgtaaaaagtcctctccattatcatgatagcatgaataactatatttcaaaacctcaacaccaagctttttctccaattcagcccctaatttaacaatctcctcctttgttttgtcatatagaggagcttctatcttaaccttatttagtgttccatactccaaaactttattaaatgcctcaacaaattctattgtgttgtctgggaaagtaactccttcctctttatttattccaatgaatatcttctctgcatccaatgcctcagcaaatccgcttgctataccaaacatgattacattccttgctggaacccatacagccttcattgtttcataagctttctcactatctaactcttccatttttaatgttggaatttccttttcagttattaaagagctttttccaaactgtttaacgaatggtaaatctacaacaatgtgttcaatacccaaaatctcacaaatcttctttgctgaattaatctctctcttagccgctctttgcccatagttaaaagttattgccgtaacttcataacctaaatctttagctatcagtgtgactactgtagaatctaatccaccacttaaaacagttattgccttcataataatcaccttttaaaattatattaaaattaaataattggaatctttggaattttgctgtaataaaaaaaggtaaaagagaagaaattttagtagattaagtatttacctgtctcccagtcagtaactgctgttctgaagtcatcccactcagctctcttgatttccatgtagttttcatatatgtgttttcctaaagctttctgcaagacttcatcacattctaactcatccaatgcagcagctaagtttgcaggaactgactcaattcctaactgctttttctcttcttctgacatcttgaagatgtttctctcaactggctctggagctgtcatcttcttcttaattccatctaatccagcagctaacatacatgcaaatgctaagtatgggttgcatgttgggtctggagctctgaactcgattcttgtagcttttcctcttgcagctgggactctgatgatagcacttctgttcttgtttgcccatgcgatatttacaggagcttcgtaacctgggactaatctcttgtatgaattaactgttgggtttgttatagcaactaatgccttagcgtggcttaagattccagcaatgtagcttaaacatgtttcacttaatccattgtaaggcccttctgggtcgtagaatgatggttctccgttaaaccagacactctggtggcagtgcattccgtttccgttcattccaaagaatggttttggcatgaatgtagcttttaaaccgtgcttcttagcaatgtttttgattgtcatcttgaatgttataacgctatcagctgtctttaaagcgttgtcgaatttgaaatcaacttcgtgctgtcctggagcgacttcgtggtgtgatgcctcaacgtggaagccgaggttttctaaagctaagacgatatctcttctaatgtctggagcgtcgtctaatggttcaacatcaaagtaacctccatcgtcagcaggaacccatctgtgtgggttgtgtgggtctctctttaacaagaagaactctggttctggaccaacaaagtattctccattcatttctttctttaattcttctaaaatagcttttaatctgcttcttgggtctccttcgaatggtgtcttctcatctttataaacatcacagataactcttgcaacacttttctcttcaggtctccatggtaaaacagagagtgttgataaatctggttttaataacatatctgattcttcaataccaacaaaaccggtaattgatgaaccatcaaaccaaactccattttcaaagatttctcttaattcttcgattcctttttctccagccttaactgggtatgcgacattttttgggaatcctaagatatctacgaactggaatcttatgaacttaacgttgttcttctttacatattctattgcttgttcgacgttcatttccatcccccaatgcaatttgattgaataattctggaagtaagtttcctacttccatatatatataatttacggtatattcaatttaaattaaaatataaaaatttattcataaatatcaagtgctctattgtaacactctatagcttcattaatttttccaagtttttcgagagctatggctttcccattccaagcatctggaatatttgggttaatttccagcactttatcaaaatattttatagcttcattatattttccaagcttgtttagtataatacccttgtatagataaagtaatgggtcatctggattcaattttaaagcttttttagtatattcaagggcttgatttaatcttccaagataaatcaaaatttgtattatgtacattaatgcacgaatatctttattatttctttcaaaaactttttttagacattttaatgcttctccatatcttccaagtttaaataatatttctcctttgtacaataaggactggcaatctttgggatttatttttaaagcattatcaaaacattctaatgattttttaagtttgccttctctatataatatttcccctttttcagcccaggcaatagctgattttggatattttttcaatattttatcaataatttttaatgcataatcatactctccaagtttttttagtataaaggcagttacatatttaacaggtaaatcagatttttctaatctgcataattttaagaatacctcttttgcttcttctaatttacccaaacttaccaataaagctccttttaaaaaatttgctaaaatatattttggttttaattttaacgctttatcaaaatattctaatgctttatcattttcccccaatgttcttaatattcttgcttttcttacataaacatcgggagattccctaacctctaagattttgtctatcaataatagggctttttcataatttcttttttcaagtgcatcaaaatattcatcccataaaatgctttcattatatatttccatattcaccccctcccccaaggttttagcaatatgcgattttaatccccctattttacgaatttcgttaaattattattactatgatattatttattaaaattattttagtgtaaaatataaatttttctatctgtgaatactggatattttcttttatttccatattatttccacattagtttatttaaagttaataagattggggtattaattgttttatgacattatacgctataatataattataaatataaaaatttaattataaaagtccataaattacttgtttatcccaatatttgtttattttgcatttcctacatttttatacttggctctataaattaccgaaaagtttttatactatttttagagtagttaggaatgtaatttccttttccctaagaataagatttccgtttccaagtatatatatggaggctgaaaaaaatgaaaaaagttgaagcaatcataagaccggagaagttggagattgttaaaaaggctttgtctgatgctggatatgttggaatgactgttagtgaggttaagggtaggggagttcaaggtggaatagttgagaggtatagggggagagagtatattgttgatttaattccaaaggttaagattgaattggttgtaaaagaggaagatgttgataatgttattgatattatatgcgagaatgcaagaacaggaaacccaggagatggaaaaatcttcgtcataccagtagaaagagtcgtaagagtaagaacaaaagaagagggtagagatgtactttaaaaatttaattatgtaatttaaagagagttgtggggtgaaaacatagctactgcggatttgtttgcgaatgccacagatatacattcaatagttcaggcattgaccaccttagcaaatgcttcagatgtgttcttccttgtagtaatgggagttcttgtctttatgatgcagtggggctttgcgatgcttgaaggtggtcaggtaaggaagaaaaatgttaataatgttatgatgaagaacatggttgattggttgattggttgtgttgcatggttattcattggtggaattttatgttcaaaaggttttgatttatctgcatttatagattggtggaaacaaatacttggaacaaactggccaaataatggattggacttagcaagctggttctttggtcttgtcttctgtgctactgctgcaacaattgtctctggaggagttgcagagagaataaaattcagtgcttatgttctaatttcattgattattacaggtctattatatcctctcttcgtatatttaggaccttggggagcaagtatagttccatggcatgactatgctggaagtttggttgttcatggtttaggtggttttttagctttgggagcaattgcagcattaggtccaagaattggaagatttgttgatggaagaccagttccaatattgggacacaacattccaatggcagtatttggggcatttgcattggcaattggttggtatggattcaacgtaggtagttcattggctttaggagatatttcagggcttgtatgtgctacaactacaatggcaatggctggaggaggaataggggcattaattgcttcaagaaatgatgttctatttacagccaacggaatagtcgctggtttagttgcaatctgttcagggacagatgttgttagcccaataggtggattaataattggtttaattgctggattgcaagttccaattgtctataaacttgttgaaaaagcaggattggatgatgtctgtggcgtagtgcctgtccatggaactgcaggtgttataggagcaatcttaactggaattttaggattaaaaatatttggtggagcaggaggcgttagtttaatagaccagataattggagcagtattttgtattatttatggaacagggcttggatatattttagcgaagattgttggtattgcattaggtggattaagagttagtgaagaagaagaaaaaatgggattggatatggcagaacacaaaatgcctgcttatccagaagagacagttatctaaaattcttaatttattttaatttatttttggacaataattatttaatcctaaaccaacaatatccgttttcttttattattaccttatttccatcccataaatttattttgtaatcttttttagtcaattctctcatgcagcttgccaatattgagggaattggacatgcacttcctggaatttctgcttctccaatctgctttggacaatatttacacttatcaatttttattcctattttttcatcatcaataacaaaatcattgcacatgtcacaaaaattaattaaaaattttattaattccttatcttctatttcttttggattaactgtctcttttaaacactttgctatctttttcccacccagaacccacaacatttgttgttccttgatttaaaatccccaaccttgaaaactctgctatcatcgatgttaaaacaatgtgaagattttttttaggctcctattcttaaataattctttatattttaccccaaccccacctaataattaaaaatacgttaaatttaattaaaattgttttgtattataggagatatataaatatttctatgtcatatcgttatcaaatattgagggatatggtgagaagatgattctcaagcatagaagaccaaatatatatggattaatgaataaagaggggaataaagaagaagttgagatgataattaacgagttattaaatagggattataaaataacgttcctcccttcaggaagttcagcagtctttttatcaatgtggatagcaaaaatttatagtaacgagatttcaatcccagatatgggaggttggcagggatttttaaaatttcctaaattattgaatctaaaaaataatatgatagaaacgaatttgggaattattgatttagaaaaattagatgaaagtttaaaagaaaactcatcacttattttaacatctttagctggatatttagctccacaaccattaaaagaaataaaaaaattatgtgaggagagagaggttttatttattgaagatatttcaggaaaaattggaggagattgtggatatggagatattgttgtttgctctactggaactccaaagatattaaactgtgaatacggtggttttttaggaattagtaaagaaattgaagaaaaattaggtaatgctttaaatgacattaaaattttatccaaaacatataaaacaataaactattttggacttttaaaagaggagttactaaatgctaaaaaaacgtataagaaatatgtagaggcatctaaaataattaaagatgaaattgaaaatgcctattttagagagtttgagggaatatctgtatttattgaatgcgataatccaaaaaatatctctaaaaaaataaacagtttaataaaattggacaatagaaaatcaataacaacaatctgtccaaactatgatagaattttaaaaaatgggattgtatttgaaacaaagaaaattgatatctctgaattgaacagagaagttatcaatgaaattattatagcattaagctctattttataattataatattattttagaacattgcttttattttttctgcggctcttttcattgttattctgattaaacctaaattaactttcgcatcagttaggactactaaaattccctctcctgcatcgaccattagggttttaccgtgctctccttcaatcattgtttgttctaaagtacccattccaatttctgctgctgttctttcagcagccccaaatgctgctgaagccatagccccaactaactcagcatcaacactcccaggcaattgagaggcaataactaaaccatccttaccaacaaccatagaacccttaataccctcagtcttattcaactccaacaaaaccctatcaatcatattttcacccttatactctggcttatgtaaattatgcgtttttgctatatataattttttaaatttatttgttatgtgtgggacataattttatttataagttcgtcaagtccatcttttttcactgcacaacctttaacaatgaattttgggttgcaaaagttataaacttcggaggtatcgatatctccaacatctgttttatttataaaaattccgtacgggatttttttagattctaataattttattatttcttcatcttctttagttattccttttgatgcatccaacactactaaagcaaaattagtcccttttaatgccaattctctcatgaactcaaatcttttctgccctggagtcccaaagaagtgtatcttcttatcttttattgttaatgaaccatagtcaatagctgttgtaattcctttgtattcaacttttccaattttatcaattaaattttccattaatgttgtttttccaacatcacttgaaccaataactacaaccttaacctcatcttttttcatgaatctcccctaaaaataaaatattataagtttaatgctcaaataattttcttgcacttctttttattgccccctctgcagcagcccctcctattaaagtttttatctccttaactaatgattgagccgctacaagtgttgttggttttatttctgctttttctacttctgcctttaatgtttcatctaagttttgaagaatctctaaggcagcatctaaatccttctgtctatctaataacttcattgatgaagcactccttattaataactctggatttaatgcctttaccatcccttcaatacctgatgtttcaacaagagaagccattgtctgtagggtcatgataacttgctgttcaatcatcttcttaggagcatttataatctttcttccaactgtatagtagtccagaactcccgataaagcaactgcagtaactaaactccccatatcagcaacaactgaagaaacatcagcaggaacaacataagcctcttttcctgcacttttggcaagctctacagctttttttatctgttcctcagtagccaattcttttccatcagtggttttcccaccaatcacataatgtccgtgttgtggagttccaggaacagctgctggatgcattgatgaaattcctacatcctttctttttgttcttaatattggttctaatgagtagtataacactacaggtgaaacagtgcaggtgttacaaataacagcattttcaggaacatgttcaataattgtctttgctattctaaatgttgccttaccaaaaggggtaaataaaacatgaatttccccgtgctttgcagcttcgacatcatcactaacaaccttaaccccagcatcttcaacctttttccataaatcatcactcattatgtttttatttggttcagctaaaacaacatcatgccctgcctcagcaaattcaatagccatccttgaaccgccataaggtggctccccaccgaatttttctggaaggtttaatttatttatgtatagattttgattccccgctccatatacggataccttcatgttatcaaccttgatttttcttatattacgcatttagagtttctgatgattattatataaatactttattatttatttttcttattattatgctattcaccgccctcaactactttaatgtgttctctaaagcttttggaatggcgttaattatctctgtaatttgagtatttggattaacattagctatctctccaagttttctatttattttacatcctaaactcagtgcttcctctgttttaaaatcaacacttattaaagatgatactatctctgttaaagtatctccagttccaccaatacattccattgcctttatttttggttcttttattttatcaattatcttttcctctctaatagtatagtcagtttcccctttaacaaccatatactttggcatttttagtttataatccctttcaatgagttttggcacttcattatcgtctatctcagatataaaacctctaacataagctggatgagaagctttttcatctgctaagaatgccaattcaccaacatcaggcaaaaagagataaaatttatctccaatatttgctgcctttgcagcatacattcctccagcatctgcaataatctttggagagaaatttatctctctaatttttgaaatctttggttttatataatgtattataaccaaatcatcatctatctcttttaatgcgtcataaatctttaagcttccatccccttctccaatatcccctgtagttattactttaacatctttttcatcaaaatactccaaagtttttaaaacagcccctatcaaagctccggccctccatagaaataggaaattccttgttatttattattttatctccttttaaaatgggttttccaatagttaaatctaaaccttttattggcatagttcctgctataatcattagtaatccctacaatttattcattttgagtattaactaactccttagctttttcaaacgcccttctctaacgcatagcccaaaactgcgataaatgtatctccagcccctgaaacatcatgacctctttgacttctgttggaacatggtaaatatttcatcaacagttattaatgtagctcctttttcacctctcgttataacaaagtttgaattgtatttatcaactgattccaatccagatttttccaactcatcatctttattttctatctcccttcctaaaatttgggaagcctcttttagattcggttttattaaatagacatccttataaaagtcattttttggttttgggtcaattaagatttttcccttaaattctttttttatgtcatccatgagttcctttgtaattaatccctttgcataatcagagattactaatatatctgattttccattgagatttttaataactcccaaaattttactgcttaactcatcgtttattggatagattttttcataatcaaccctaagcaattgctgattataacccatagcaacaaatctatgctttactattgttggccttcttttttaacgtttctctatcttcaattatcatctatttcaccaattttttctcaacctcctcacatataacatgataaattgttagatggcactcttgtatccttgctgtgtcattagaaggaaccaccaatgccaaatcaacaatatcctttagctttcctccaccttttcccaataaaccaattgtataaatccccatttcctttgctttattagctgcctttataacgttttctgaatttccacttgttgatataccggccaaaacatctccttcttttcccaaagcttcaacttgcctctcaaaaatcctatcaaaaccataatcatttcctatagctgttaaaattgatatatctgttgttaatgcaattgcaggcaatcctttcctttctaacttaaaccttcctacaatctcagcggcaaaatgctgagagttagctgcactcctccatttccacaaattaaaattttatttccattttttaatgcattatatatgacttcaatagctttttttaacttttcctcatcttcttcaatgaattttagtttcacatttgcactttcctcgaaatactttttcataatcatcaccaaattatttatacctactatattaatactatataattgtaacataaattaatttaataaaaatttactaaagggagaggatgataagaaaggcagtaattccagtggctggttttgggactcgactattaccaataacaaaggctcaaccgaaggagatgcttccagtagttaataagccaatagtgcaatatgttgttgaagatttggtagaagcaggagtaaaggatattttatttgtaactgggaagggaaaacaggcaatagaaaaccactttgacgtaaattatgagttggagtgtaaattagagaaatctggaaaatatgaacttctaaaaattattaaagaaattgataggttagggaatatattttatgtaagacagaaagagcagaaaggtttaggagatgctattttgtatggggaggaatttgttggggaggaatactttatagcaatggttggagatacaatttactctaaaaatattgtaaaagatttaataaaagctcatgaaaaatacggctgttcagttattgcattagagagagttccaaaagaagatgtttataaatatggagtaattgatggggaagagatagaaaagggcgtttataaaataaaaaatatggtagaaaaaccaaaagttgaagaggcaccttcaaatttgattataaccggggcttatttattatctccaaagatatttgaaaaaattagagaaactcctcctggaagaggaggagagattcagattacagatgctatgaatctacttttaaaagaggaagatattataggggttgaaattaactgtaaaagatatgatattggggacgctcttggatggttaaaagcaaatgtagaaattggagctgaaagattccctgaatttagagaattcttaaaagaattcgttaaaaatttataatctaattttattttttattaagttgggatagtatggatacagcaataatattgggacttttagtggctgtgttttatggggttgggacattttttgcgaaaattgtctgtgaaaaaaaccctttatttcaatggatagtggtaaatatagttgggattatattatgtttaatcatattactcaaatataaaaatataattattactgaccaaaaaattcttacttatgcaataatatcagcagtcttagtagtgattggttctctattgttatattatgcgttatataaaggaaaagcaagcattgttgtgcccttatcatcaataggtccagcgataacagtagctctgtcaatactgtttttaaaagagactctaacacttccacaaatgattgggatagttcttataattattgggattattctcctttcaatatctaattaatttatttaatttataaagtttaaatttataaggtaataaaaaataaagataaaaatagttactgcccttctaaggttaataaatatcttcttgccccttgcattccaagctgtaattttattgcctttataagttcataaacatcttcaacagtttcagcatcatataacgcttccttaaatttctctctttttgaaggttctatcaaatttaacaagtattcaactgtggcaaccaactcaatatatttcctctctctattcattaagttatctaattcatttattatctcttgaatttttggagacggcattcatttcacctattgtgtaattttaaatatcattactacataaagtcatataaatattttaacaccatactcaatatttttatggtgagaacttggcaatgattggtttagtagggaaaccaaacgtagggaaatcaacaatgttcaatgctttaactgaaaaaccagcagaaattggaaattatccatttacaacaatacaaccaaataaaggtatcgcttatataacaagcccctgtccttgtaaggaattgggagttaagtgtaatccaagaaattcaaaatgtatagatgggattagacatattccagttgaagttatagatgtggctggtttagtcccaggagcacatgaaggtagagggatgggaaacaagtttttggatgatttaaggcaagcagatgcatttatattggttgttgatgcctctggaaagacagatgctgaaggaaatccaacagaaaactatgacccagttgaggatgttaaattcttattaaatgagatagatatgtggatttatagcattttgacgaaaaattgggataagttggcaagaagagcccaacaagagaagaacatagttaaagctttaaaagaccaattaagtggattgaatatagatgaggatgacataaagatggctattagagatatggatgaaagcccaattaaatggactgaagaagatttgctaaacttggctaaaaagcttagaaaaatttcaaaaccaatgattatcgctgcaaataaggcagaccacccggatgcagagaagaatattgaaaggctaaagaaagagtttaaggactatatagttattccaacatctgcagagatagagttagctttaaaaagagctgaaaaggctggaattataaaaagaaaagaaaatgactttgagataattgatgaaagcaaagtgaatgaacagatgaggagagcttttgattacataaaggactttttaaagaagtatggaggaactggagtccaagaatgcataaataaagcttattttgatttgttggatatgattgttgtctatccagttgaagatgagaacaaattttcagataagcaaggaaatgtattaccagatgcatttttggttaaaaaaggaagtactgcaagagacttagcttataaggtgcatacagagttgggagagaaatttatctatgcaatagatgcaaagaagaagattagagtaggagctgattacgaattgaagcataatgatattattaaaattgtctctgccgcaaaataattaaatttttggtggcctccatggctacaacttatgagctgagaatttatggaaatgtggagtgtgctgaatttatagataaagttgagagtttaggaaaattgttggatgtgaatggggttgtttatgtttataaagacagtgttaggattttggcaaactttcccaatgagaagaaaagacagctttttaaggaaatcattaaagatttagaagatgatggtgggttaataaaggttgaaaggatagaagaaagagatttaaatacatatattgaatttcctaatggattgaataagatttcaacgaatgagttaaaagagattaataaaaagttggataaaacaattagctatttagagaatatttttaatgccttagagaagcaaataaaagtttcagaggagattagagacatattgaaagatacctttgaagtttaactttattcaaacaccttactcatacacccagccaacaaaccggctatagcatcatctaagaacataaagcctttcctatctaactctccaattattccgggttttttagcatcatagaatctaaagttaaatattgccttagttccagcaatctcatttgctatagctaatccaataacctcatcaacatacacatagtttgggtcttcgttgtagttgaatggcagattgttagctctgccttcattatccaacaaaattgctgcaattaamaaagttgagacattagggttagacaactgctttaamaaaatctccttaagtttctctttaactctgtctctttcttcattactcccaatatataaatccattccagcatccaataagctgtcaatagttattccaaactcctctaattttttnataatnattttctcactttaatattttggattttatgggcatatctcttataataaacattaaaataaaatctcattttttattaaaaaacttaaatattctatactattttgttgttatctcaacaccattttcagttattaatattgtgtgctcagcctggccaactattccattctccctctcttttaatattggataaccgtaaatgcaagatgccctaattaacgagtttaaagccagcctctcgctctcattttttaaaacccatctttcagcaaagggtagataagggtaattttttgatataacgtctaaaagttttcttgcttgtggcaatctaattggtcttttggctaaaaatttatatatgtttccaagattcccatctttaaccattccaaagccatctgttgcaaacggctctatagccaccaaatctccaacatctatatattgattggttctttcatagacatttggaatactaattcctgtatgcaactcatatctatgcatcacatgtccagagaggttggatattggtttataaccataactctcaataacctcctgaataatctttcccatctctccaatgttcattggagggtttatctccttaataactgtatatagtgcatcttcagatgcctttaccaaatctttataagagtttgataaatctactgttatagctgtatctgctatatatccatcgacatgagctcctaaatctaatttaacaacatcatcatctttaaactccaagttatcatttaattttggagtgtaatgagctgctatctcattaattgatatattgcacggaaatgctggctcccckcctaattccctaattctattttcaacaaattcagcaacttctaatagcttaactcctggcyttattaattttacggcctcctctctgacyttagatgctattttccctgcctctataatcttttcatacccytcaatctccatactttcatcctttaagttttggttttaataagttttttagtgttgtttgataacctttaaattgattgttatttattgctgaaactataatataatcaatttgtctttctaagttttcaatatctttcccattttttaagttgtagataatatccttgactatattttttattttctccttaacttcatctgagaacgtgggaatttttgcattctctaacaacttttgtgtaaatgccactctccctcctcttcttccaccatttgcaagataataatttctaaaaaatgagctgttcaaatatcctaacaaaaagtatatgtcatcatcgttgtagggttggataaatataacgtctcctgaaggtaatagttcatcatctcctaaactaaacctattatatggttttctgtctaaagttggaacatatattcgttttttatttagattttttattaaaaatttatagtttctcaatgcctgccaattaaaccattttttgttttttggaaggtatctattctccattctgtctttaaacttcaacaattttttatatatgtttggatatttggttttaaatatttcttcatcttttaggttgtcttcaattaatatatattgaacaaatccctcaactacaaaccttttacagttttttgccttaacaaaattttttataagttgtttttcatcttcatttagctttgagatgtcatcttcatttaataaaaatgcctcatcaaatccagaaactaagcccactccaacttttgctatatcctttaataacacatgaggaaaatctgggatttttgtaaaaaaggtagaccaaggtttctggtgtagtgtaatgaggaatttccatgtattcaaaaatatcgtttgatttttttgcatttaacacattaatagctttttcttttatctcttttaatttaactttttttgagataattctaataacatcaattttttcagatttgtggttaaattctccttttttaaacttaaatattattgtttcaggattttcatttttaaatagcctaacttcatccaaatcaataattatttccaattttccatgttttagaatgttgtctcttacaatttttgcatatgtgttataaaaaaagtgatatggaacaatataaatcaactctccaccatcttttaaaagatttattgattttataatgaaagcataataaatgtccccctcacttgtgcctataatccgttttacttctttttttataaattctggaagactgttgaaatgggcatagggaggatttccaataattaaatcaaatttttctttaaagttatagcttaaataatctcctaaaattatctcaaattcatcaaattttgccttgcagtggttgtataaatctttatctatttcaatacccacacaatttttgtatccaaattctcttaatacctctaaaaatattccttttccgcatccagtgtctaacactaatccattttttgggattgtagaaagatttatcattaattcagctatttcttttggagtttcaacaaagctaatcttctccatgtttgccctctttaatattaatcagttggatttttattgagttcaagacaagaatttctgtttttattgaatttaatgacttttctaaagattctaaaattgcatctataagttttttaacaaaagcaaagtaatctattgggtcaccaagatttgggctataccttatctgaaacatgttatttcttggattaacataaaaatcgtccttaatctcttctaataagaaaaatttgtatcctcttctatacttatcaacaacaaaaattccataagatacaatttcattacctgaaattctattatagaccaattctccatttatggttatttctgacgttaatctctgccgttttatgcccaaatataaacgtaagaggttattgtatgttgttacatcgtttcttgtattactttttaaatcaccaaatttattgtttatgaatattaaaaaattctttccatttattattccatagcataataaatcataaggtgtccttctaccttcataggaatatatttcatcctttggttcagaaaatttaatttttaagttttcttcagagattgtatagtcttttaataaacttaaaaccttatcgtccaaatttctatcgttaatattctcatcattttttattttattataaatttccctaaatatatctcttaattttcccgataaaattttaagttcgttattaaccaattttaccaccatttaatgcattatctctttatgacaattgttaaaatgtctccatcctctaatttatggtctaatccaactctctgccctggatgctttgctgacttcccccaaacttgggcatacctgaaatttctaacgaaatctttatgcagtttttcacaaacatcttttacagtagctcctcttctcataattagtggttcatcaaagtctggctttttcccctgtggttttagataaatctttataaaacccaatttctcatagattttctctttcaataaatccaagttaattcctttgttaccagaaactaagatataatccttaccaaattcctctaacttttgttttatatattttagatactcctcatcagctaagtctatcttattaactaccaccaaagaagggatataaactctgtttccagctacaacatcaataaactgctctaaggttatatcctcccttataacaacatctgcgttgtgtatcctatattcatttaatattgcttcaattgtatcttcatcgatatgggttaatggaacggttgaactaacgttaatccctcctctctccttaactttgattttaacatctggaggagtttggtctaatctaattccaacattgtagagttctttttcaagcactggtaggtggtctaatgtgtagatatcaactgttaataaaatcaaatcagcacttcttactgcagataaaacctctgtccccctacctttccctgatgaagcaccaacaataattccaggagcatctaaaagctgaattttagctcccttatattctaatatacctggaacaattgttaaagtagtgaaagcataagccccaacttccgatttagcatttgttaatttatttagcagggttgatttcccaacagatggaaatcctacaaaggcagctgtagcgtctccacttttctttacagcatagccctttcctcctccacctccccctctactctgagcctgctctctcaacttagctaatttagcctttaacctaccaatgtgtttctgtgtggctttgttatatggtgtcttttttaattcttcttctatccttctaatttcttcttcaattcccataacatcaccaacaatattaaatttatggtttctaaaaataaaaatcctcttaagagataacaaaaatagcatttataattttacgcatgcatttattataaattgcgtttgctacattaaataaaatagttaaaaaaagagaaatttatagtttcctctgactacctaagaagtcacattcttgttctttatagagcttggacattaattggggctgaaagccccaacttaatggacgggaggtatcccaataggaggtctcctcctatggttataattcatcaactaatttaataatctctttaactctgtcatctacgatgtagtagaaattccatgttccttcttttcttgctttaactattccagccttttttaagatgtttaagtggtgtgagattgttggctgtggcttttttagctcatctattattttacaaacgcacatgcttccattttcagccaataactttaaaatcatcaatcttgttgggtctccaaatgccttgaaaatttctgccgctttttcgtacttctccattgttatccctcgtgattattttttatttctattaaaatgtttaagtatatatttagacatatatttttccatattgatgtttaaattgcaatcaactttactataatacattactagtatttaaatattttggttttgtttatttcagcttggatacgtcaatctcaaccttgatagtctttggattatcaacacctttcaaggtttcaatcattgctttaattgtgctaccaacaatcttagagacaaaaggaacagcaggaattattttaccatcaacaattatttttatacctttcgctaatacacaatcatcccatcttgcttctcctttaacaactgccttaacaaatgttctgcagttatacccacaatgtccacagtttaagttcattgtaggaactacggctttttcataaataacttttaaaacatcgtcaatgttgtagttgtaatcttcaattatcattgctgtatggtcatcaatcaaatcactcccatctttatccttaagcataactatcttagggatgtttaacctttttaaagcctctttaaaaccttctataataacaaaatctatattgtaatctgataatactgataaaatgttttctaaatccatcctatctgtaaagaaaactgttttactgtcagttgctaaaactgttattttagctcccgcgtttgacaatctgtaagtatcagttccttttttatctacttctacatcttctttagtgtgcttgataactgctatttttttatcagaatgttttagaatttcttcaattagggttgttttaccagaatctttataaccaataacgcctatgactctcatgttatcaccataaatataaaaactgtaggtttaacatatttaaattttatgcattaattattctatcacaaaataaaaatttgagggatagtatatgatgttcgttcatatagctgataatcacttaggttatagacagtataacttggatgatagggaaaaagatatttacgactcatttaaattatgtataaaaaagattttagagataaagccagatgttgttttacatagtggtgatttatttaacgatttgagacctccagtaaaagctttaagaatagctatgcaggcgtttaaaaaattacatgaaaataatataaaggtttatattgttgcaggaaaccatgaaatgccaagaaggttaggggaggaatctccattagccttactaaaagattacgttaaaattttagatggaaaagatgttataaatgtaaatggggaagagatatttatctgtgggacttattatcacaaaaagagcaaaagagaggagatgttagataaattaaaaaattttgaatcagaagctaaaaactataaaaaaaagatattgatgcttcatcagggaataaatccatatattccacttgactatgaacttgaacattttgatttaccaaaattttcctactatgcgttgggacatattcacaagaggattttagagaggtttaatgatggaattttagcttacagtggttcaacagaaattatttatagaaatgaatatgaggactataaaaaagaaggaaaaggattttacttagttgattttagtggaaatgatttggatatctctgatatagaaaaaattgatattgaatgcagagaatttgtagaggtaaatattaaagataagaaatcttttaatgaggcagtgaataaaattgaaagatgtaaaaataagccagttgtttttggaaaaattaagagagaatttaaaccatggtttgacactttaaaggataaaattctaattaataaagctattatagtagatgacgaatttatagacatgccagataatgttgatattgagtcactaaacattaaagagcttttagtggattatgcaaataggcagggaattgatggggatttagttttaagtttatataaagctctattaaataatgaaaattggaaagagttattggatgaatattacaacactaaatttaggggatgagtatgatactaaaagaaataaggatgaataactttaaaagtcatgtgaattcaagaattaagtttgaaaaagggattgttgcaattattggagagaatggaagtggaaaatcatctatctttgaagcagtgttctttgccttgtttggggcaggcagtaattttaattacgacacaataataaccaaaggaaaaaaatccgtttatgttgaattggattttgaagtcaatggaaacaactacaaaattatcagagaatatgattctggaagagggggagctaagctctataagaatggaaagccttacgctactacaattagtgcagttaataaagcagtaaatgaaatcttaggcgttgatagaaatatgttcttaaactccatatatattaaacagggggagatagctaaatttttgagtttaaaaccctccgaaaaattggaaacagttgcgaaacttttgggaatagatgagtttgaaaaatgctatcaaaaaatgggggagattgttaaggaatatgaaaaaagattagaaagaattgaaggagagttgaattacaaagaaaattatgaaaaagaattaaaaaataaaatgagccaattagaagaaaaaaataaaaaattaatggaaattaatgataaactaaataaaataaaaaaggaatttgaagatattgaaaaattatttaatgaatgggaaaataaaaagttgttgtatgaaaaattcataaacaaacttgaagaaaggaagagagctttagagcttaaaaatcaagagcttaaaattttagaatatgatttaaatactgttgttgaagcaagagaaactctaaatagacataaagatgaatatgaaaaatataaatcattagttgatgagattaggaaaattgagagcagattaagagaattaaagagtcattatgaagattatttaaaattaacaaagcagttggagataataaaaggagacattgaaaaattgaaagaattcatcaacaaaagtaagtatagagatgatattgataatttagatactctattaaataaaataaaagatgaaattgaaagagtggaaactattaaagatttgcttgaagaacttaaaaatctaaatgaagagattgaaaaaattgaaaaatataaaagaatatgtgaagagtgcaaagaatactatgagaagtatttagaattagaagaaaaggctgtagaatacaataaactaactttagagtatataacattgcttcaggagaaaaaatccattgaaaaaaatattaacgatttagaaacaagaattaataaacttttagaagaaacaaaaaatattgacattgaaagtattgaaaattcattaaaagagatagaggaaaaaaagaaagttcttgaaaatctacaaaaagaaaagatagaactaaacaaaaaacttggggaaattaacagtgaaattaaaaggctgaaaaaaattttagatgaacttaaagaagttgaaggaaaatgcccactatgtaaaacaccaatagatgaaaataaaaagatggaattaataaatcaacataaaacccagctaaacaataaatatactgaattggaggaaataaataaaaaaattagagagattgaaaaagatatagagaaattaaagaaagaaattgataaagaagaaaatcttaagacactaaagaccttatatcttgaaaaacaaagtcagattgaagaattagaattaaaattaaagaattataaagagcagttagatgaaatcaataaaaaaatatccaactatgtaattaacggaaagccagtggatgagatattagaagacattaaaagccagctgaacaaatttaaaaacttttataaccaatacttatcagctgttagctatttaaatagtgtagatgaggaaggtattagaaatagaattaaggaaattgaaaatatcgtaagtggatggaataaagaaaaatgtagagaagagttgaacaaattaagagaggatgaaagagaaataaacagattaaaagacaaattaaatgaacttaaaaataaggaaaaagaacttatagaaattgagaataggaggtcattaaagtttgataaatataaggaatatttaggtctaactgaaaaattagaagagcttaaaaatattaaagatgggcttgaagagatttataatatatgcaactctaagattttagcaatagataacattaagaggaagtataataaagaagatattgaaatttacctaaacaacaaaattttagaggttaataaggaaattaatgatatagaagaaagaatatcctacattaaccaaaaacttgatgaaataaactacaatgaagaagaacataaaaaaataaaagagctctatgaaaataagagacaagaacttgataacgtaagagaacaaaaaacagaaattgagacaggaattgaatatttaaaaaaagatgttgaaagtttaaaagcaagattaaaagaaatgtctaatttagagaaagaaaaagagaaattaacgaagtttgttgaatatttagacaaggttaggagaatatttggtagaaatggatttcaagcatatttaagagaaaaatatgttccattaatccaaaaatatttaaatgaagcatttagtgagtttgacttgccttatagctttgtagaactcactaaagattttgaagtaagagttcatgctccaaatggagttttaaccattgacaatttaagcggtggagagcagatagcggtagctctctctttaagattagccatagctaacgctttaattggaaatagggttgagtgcattatattggatgaaccaactgtatatttagatgaaaatagaagggcaaagttagctgaaatctttaggaaggttaagagcattccacagatgataattataacccaccacagagagcttgaagatgtagcagatgtgataatcaatgttaaaaaagatgggaatgtttcaaaagttaagattaatggatagttatgaggaggatataatatggttttaaataaagttacatataaaataaatgcatacaaaataaaagaagaatttattcctaaagaagtgcatttctatagaattaaaagttttgttaatgaagcatttaatttttatagatttgttaatttttatggtggcatgataattaataaaaaagataaaagttttgttttaccatacaaagttgataataaagtattgaaatacaaagatggaaataacgaaatcccaatagacattgaatatattaaatcattaaaattagaatatgtaaaaccagaaatagctgaaaaacttgttaggggatatcttaaatctgtccataaaatagagccagaattatcaagaattataaaaaacattagaaaacacaaagtagtggaaaatataaaagttgagtcatattgtgagtatgaagttaaaaaacatgatggggattattatcttatattaaactttagacatacagcgtctattacaaaacacttatgggattttgttaatagagataaagcactattagaggagtatgttgggaaaaagattatctttaaacctaatccaaaggtaagatatacaatttcactggttgatgctccaaaccctcaaaaaatagaggaaataatgagtcacataattaaatattacaaatggtctgaagatatggtaaaatctacttttggggagattgattataatcaacccattatgtattgtgaagaaatcttagaaccatttgctccacaattttgtaatcttgtattttatatggatgaattagatagctatattcttaaagaattgcagagttattggagattatctaatgaaaataagggaaaaattataaatgaaatagcaaaaaaacttagatttatagataatacacctaaagaattagaatttatgaaatttaataatactccattgctcgtgaaggatgtaaataaaaatcctaccaaaatatattcaacaaatacattatttacgtggatttacaatcaaaatgcaaaaatatatctcccatatgatgtcccagaaattataaggaacaaaaatttattaacatacatacttattgatgaggaaatcaaggatgaattaaaagctattaaagataaagtaaataaaatgtttagaaactataacaaaattgctaataaaacagaattgccaaaattcaattatgccaatagatggaaatatttttctacagatgacattaggggaattataaaagaaataaaatctgaatttaatgatgaaatatgttttgcgttaattattggaaaagaaaaatacaaagataatgattattatgaaattttgaaaaaacaactttttgatttaaaaataatctctcaaaatatattatgggaaaattggaggaaagatgacaaaggatatatgactaataatttacttatacaaattatgggaaaattggggattaaatattttatcttagattctaagacaccttatgattacataatgggacttgacactggattgggaatttttggtaatcatagagttggaggttgcactgtggtatatgactcagaaggtaaaataagaagaatacagccaatagagacaccagctccaggagaacggttacatctgccgtatgtaatagaatatttagaaaataaagcaaacattgatatggaaaataaaaatattctattcttaagagatggttttattcagaattctgaaagaaatgacctaaaagaaatctctaaagaactaaattcaaatattgaagtaattagcattagaaaaaacaataaatataaagtttttacgtctgattatagaattggaagtgtatttggaaatgatggtatcttcttacctcacaaaactccatttggttcaaatcctgtaaaattatcaacttggttaaggtttaattgtggaaatgaagaagggttaaaaattaatgaatcaattatgcaattgttatatgatttaactaaaatgaactattctgcactatatggagaaggtagatatcttagaattccagcaccaatacattatgcagataaatttgttaaagcacttggtaaaaattggaaaatagatgaagaactgctaaagcatggattcttatatttcatataaaaaagaggtgaatctaagatatgtataaaatagttccagataccaactttttaatttacgtttttaagcataagataaactttgattatgagatagagagggctttaaatacaaaatttgaaattgttattttatctccaataaaagaggagttggaaaggttattaaaaagtagagatttaaaaggtaaagaaaaattggctgttaatttagctcttgcaaagataaaaaactataagttagttgattacactgccaattatgcagatgaagcaattttaaattatgcaaaggaaaatgaaaacgttatagtagcaacaaacgataaagaacttaaggaaaaattaatggaaaataacatcccagtgatggttgttagacagaaaaaatattttgagatttttggaatggtataatatttttattttgtttataaaaaattccagttataagcttttttattctctaatacgtcttattttaatgaatgctaaagttttcatcctccaagaggtctgattttaactccttttctacaatcttcccatcctctaaaaccacataatttccatcctccaagaggtctgattttaacatttacaattgtcagaagataagaaaaaagagtttaatttccatcctccaagaggtctgattttaacaaatgggctaattaagtatgttgtcatcccaataggccatactcagtttccatcctccaagaggtctgattttaactagggatgaaactgttaatagcattgaagaattaaagtttccatcctccaagaggtctgattttaacaatggaaacggctatataaacggtatatatataggtaatggaatgcgtttccatcctccaagaggtctgattttaacctcaatattatagattgttaatttaccctctttttcgtttccatcctccaagaggtctgattttaactattttaattataactttctcagtatcttcctcagtaatttcagctttgtttccatcctccaagaggtctgattttaactattttagaagagttaaaaatacaaaaagaatgcggtttccatcctccaagaggtctgattttaactttgaatgcaatagaaaacaattatacaagtgaatataagtttccatcctccaagaggtctgattttaacagggcaatcattcacaacataatatacttcatcactcttaatatttaagcttttctataccatatttttctaaggataaataaccatcttacaatataaaccttttagtatttaaaattttatctctttactaaaacagagtatttttatctccttaaattcaaaaatttaacttgtctgttagagaaatcttatttacttacctaattaatcctaatttttaaaaatctgaataattcaataaactcaaatattttaaacaatcaaaccagctaacccttagaaattaaataaaaatcctttgaactaattaataaattctaaatactcttattttcaaaatccaaacatattcaacaagacaatccattaaccaaacaacaaaattaaaaatcccataaaaaccttaatagtaaaattctaaaatataatatctatggaatccatataaatatataatgatgcaaaaaaaaataaagcatgattaggattcactattttcatcatctctattatttttactcctaattgacctccataaaaaataaattgcccctccccacaaaattacagcaccaaatataaacattgctattgctccaagattcatgattaccaacctttaatcgttttcattttttgaagaattacacttacaacaaacgccaatggaatgattaaagccccaaatataacataggttgttttataacctccataaccagatgttaaaacattagaggcatctaagaatacaacagcagttaatattattggagacacaactccagccaaatacttccaccaaactcccaactttatctctgaaagtttatttacatgttctctaagcttatctccaccaaatagccatatggctattataatctctaagattgctgctattggaagcaaataaccagaggcaaagtggtcaataatatccaaataatataatccagctccagttgtaaatattggtgaaattataataaataaagccaatacagcaagtagagcttttttcctactcaatgagaacttatctataattgcagatacacttgcctctacgatagaaacagcagaggatattccagcaaaaactaaggctaaaaagaatactatcccaaataatctacttgcaaatggtaataaagacagtgcctttggaaaggtaacaaaagccaagccaatcccttctgaaacagccttatctaatggaatgccacttgtatagctcatatatccaagtgttccaaatacagcaaaaccagctaaaaatgaaaaaccgcaatttaagagagatacagtaacagcgtttattgttaaatcactttttttgggaagatagcttgcataagcaattaaaattccaaatcctaaagataggctaaagaaaatttgagagaatgcacttaaccacacgttataattaaagagtgctgaaaagtctggagttaaataccattcaatcccagttaaagctcctggtagagttagtgcgtttaaaaccaacaaaattattaaaaacagtagaaaaggaatcattattttatttgctttctccaatccatttttaattcctgcacttaaaattaaagctacaattccccaaacagctaaggtagatactaaaattccataagaaactccaccaatgtcctctacaccagatgatatttgaagtatattatggaagaaataagcattagggtctgatggatacccatagataactaaaattatcaaatagtaaagacaccaggcaataataacaacataataacttgttataataaaccctgaaataactgcaaaccaccctgtccattctgaacctttatgcaatttttccaaagctaagggtgcagatttttttgtataatgtccaatggcaaattcaagaatcattaatgggataccaacacagagcaaagcaacaatatatggaattaaaaaagctcccccaccattcgtataaaccatatatccaaatctccaaatgtttcctaatcctatagccgaaccaacactcgccaatataaatcccaagttagagctccagctttctctttccatataactcacactacttttactttatactttaatttcatactattttttatatttgttctgagtaattatttaagtattatctgaagtataatgtatccttatgaagacttggagggagaatatgaaaaaaatattgacattgctattaataacatttcttttaaattctgcttttgctgtgattataaaagctccagcagtatctttaacggatagaggatacgtgggggttccaataaatattcaaattaatgttacgaagggagatggacatgtatttatggacactatgcctctaactgaattagatatgcaaggttctgcaagaatcgctgcaaaagttgctggggaagttactggaaaagatatgagtaaatataatgtatatatcacagtaagaagtgatgttccagttgttggggggccatcagcagggggaacgatgactattggaatcatctgtgagttgatgaactggagtttaaataaacatgttatgatgactggaacgataaatccggatggtagtataggacctgttggagggatattggaaaagatagaagctgctaagaaagcaaactgcacaattatgctaatcccaaaagggcagaggtatgttgaagtagagggcaacaaagttgatgcagtagaatttggtaaaaaattgggaattaaggttatagaagttggaagtatatatgaagcgattccttacttcacaaataaaaagataataatgaaggaatatccagaaaatccacttatcgaagagaaatataaagacataatgaaggagttaagtgaaaacgttttaaaaacagctaatgaaaaatatgaaaacctctctaaagagttaagtaacagttatgttggatatgaatatcaaaaagccctgttaaatgaactaactacctcaaagagcttattagagaaggctaatgatgaatatctaaaaaacaaatactactctgcaacatgctctgcgtttaacgcattaattaaacttgaaactattgaacacaccctaaaatacttaactggagaggaagatgttaaaactttcttaacagaggttcaaaataaaattagccatgataaagaaattgtttattcaaaaaatgtaactactaacaactttgaagagatattggcaggaaggataagaattgctgaagcggaaaaactcttagataatgcgtggaaatcttactatttaggaaattatgatgaagcgataaagtatggtagctttgcgaagttgaggggagatagtgcaatatggtgggtttctttaaaagaaaatgataacaatggcaagataataaatgaagctaaattaaaatcattagctcagcagtatttagacaacgctgaaacaatcttaacttatgtagaaacattattccccaatctacctactgatgaccttgaaaatgatttagaatcagcaaaagaggcatataaggatggggactatttactaaccatagctgagagtatagatacctgtgtaaaggcagagattccattggttatatttggagatattgaatactccaaaaaatatgcaaggaacaaaataaacttggctgaaaacttaggaataactccaatctcagcccttggttattatgaatatgcaaatagtttaaatgataccatttcaaaaattatgtattataaatatagctcatactacgcccaaatggatatagatgtaataaaagagttgaataaaagtatcagtgaaaatatcagcagtgaaattaatatagtcactaacgagaatgttaatattgaagaaactacaactaaggaaaataatgttggaataatgatttctgcaataattggtggattaatagggtttgcaggaggatacttagcaagaagagtttctgcttaattaactttttatatttattttttagtttatttttattattttttatggtgagaaaagtggcagaacaaaatttacaaaaaaataatgagaatgatagggaattatctaaaaatgtttatttattgggatttacaagctttttgaatgacatgagcagtgagatgataatgccaattttaccaatgcttattacaagcgttgggggaggaagtttatcaataggtttagttggaggtttaagagagtttatctcaaacattttaatggttttaattggttattgttcagataaagttaggaaaaggaagatttttgttgttttaggttatttaacatcttcaatgtttaaactactcttaggtttatcaaaaagctggttaggagctgttatattttcttcccttgaaagaatgggcaaagggataagaacagccccaagagatgcgataatatctgaaagtatgcctaaaactttgggtaaaggatttggaatacagagagcttttgataccgctggggctatacttggctctaccttatcattattgtttattctatatcttcaatatagtttcaatcaaataattttaatagctgcggttattggatttttaaccctaattcctctatattttgttaaagagaaaccttcaccctctaataataaaataacatttagagtagggattaaaaatttaccaaaagagttaaagctttttattttaatctcagctatatttaccctaagtaactttagctatatgttttatattttgagagctcaggaatttttaatgatagtagatgaaaaaatggctattataatccctattgctctatatattttatacaacatcttttacgccacattttcaattccatttggaattttatctgataaaattgggaggaagagtgttttaactattggatatatagtttatggtattgtctctttaggatttgcctactttatatctcaaaaaagcttaatattgttatttgctttatatggaattgcctatgcattatttgctggaaatcagaaagcttatgtctcagatttatcgtcagaggatattagagcaacagccttagggctgttttatacagttgtgggattaacaagcttacctgcaagtttaatagctggatatttgtggaagataagcccagaaatgacatttttatatggaagtgtcttagctataatttcaggtttgttacttctttttatataaaatctctccagtttttttatttctaatctctaagattctatgtagaggtatataagtgtcaaaatatattaaataattccctttaagctcaacatcatctaaagatatagcttttttattttcttcagcccctctatgtaatataacaacttcaaaatcttctctcttataatcaggatgccaaaagattttgtttaatatttctttaagcataaatatccccaatttatatagaatctctatctaataagccaagttcctcaccattttcatcaactctaatccttccaaaccttatttctctaatatttttaatatcctcttcacttattggagttaaaatttctaatgtttcattctcaaaatcaatagtttttaaaatacctaatccaatgcaaaagctatcttcatcaatcaatccaactattaaattgttaaaccgctctggctcaatgtaatataggatgtttttatctatttgccttggcatatttaccaaatctctttttactattgtatatcttccatcgcatttgctaccataaagtatcttccacttaaaaagtgattctaataagtatttctcatcctctaaaatcttctctccttgaaataccttggttccaccaataactacatcattaaaaccaatattataaatttttgagtttttaaagtattctttccatttctctgctctaatttcttttctttcctctctgctgaatgattttgcattttcataaacttttaagtaaaaaaccctgattttattttcaaagggctttaaaatactcttaagttcatttcttttctccaatgctattataatatctggcttaatcatttctattttcatcctctttaaatcagctccagaaccagatatcagcccagtggtatcaactataataatatcagccttatcttcagcataatcacacaataatttagttccagtaatcatctctccaaaaaattgtattggggctgttgaaccaacgaaataacttttgtatggtttaatttcatataaattgttaaaatttgtttctgggaaagctaagcttatagttgctggaggtaaaatgctcttctgccctacatcactatcgactatagcaactttaaatcctaagtttaaaagctcatttgccaaaaaagtagctaatgttgttttaccactatcaactcctccaagtaatataattttaagaggtttttgactatctttaatacaactcagagcttcaaatctatcctctggaatctctgtagtgtaataagctttacttatcatgttatccaccaaattaaagtataaataattaaaaacacaacgactgtataatcaactgccttaaaagcgtttaaagatttttcaacatctattttcccactaccaagtttataatatcctatcttctccaaagttatatttaatgcatttgccaatgtagccattgtataaccagagtttggtgatggaaccttattagcttcttttaaaaacccatatattgcctttttaacatctcctttataaaatggggcagtaattattagcaaaatccctgctattcttgaaggaataaaattggcaatatcatccaaccttgctgctaacttcccataccatagatatttctcatttttataaccaatcattgcatctaatgtatttatcgccctataaacaaaggctccaggcaaaccaaaaaatatagcatagaataaagctccaattatactgtctgttatgttctcggataagctctctactgcagccgataatacatgctctttatccaactttgaggcatctctgctaactatatgctgaacagctttccttgctccctctaaatcaccattttttatatattcaatcggctttttgcagaattcgaataatgatttgtagccaatagttgttgataacaaaaaaccatagataatatagtttaaaggaaatggtaacagcattatgcatttatcaacaaaaaaagctataactcccacaactaatagagtaataaatgttgttagtgagccaaacaaaaaatctctatatttatttttgcaatttgtagatttaaatatgttctctaaaaaagctatcaacttccctatccaaaccgttggatgaatactctctggcaactccccaatgattctatcaaaaataatagccaaaaataagattattggattcagcattatctcccttttaacaattcctcaatatctccaaaaattacttcactcttacaaaagcttggtagataaacagcagcttttccagagtttgttgcaactcttttataacctaaatcctcaattggagaaacaaccatacaggtgtctttaactacctttccaccagctttttcaataatctttgtatatcccattctatctgctattgctttaatatgaagagagcagcaaacccataaatcagcattcaattttttattttttaaaagttcagcaatttttttaatttccattaaactgcagtgagggcaaccaatacaaattaaatctggctcttcatttgttgtatttaatttttcataagcttcctttatctcctcaactccaatagatatcttttcaattttatcattaacaacttctttaactctgcattcagctgtcaagttttttgcgtgatataaggcgataccaccacttgcagccattgcagctcccaaggattttaaattatcgttatttggatttaatttatatagattttcaaaatatggaatgccattcttaacaatcttcccaactaagtaacctaaagctccataaaaactctctccatatttaaagttagagattaattgtccatctaactcaatgatatgtgttgtctttctattttcatctaagtgatatccataatatggtgtttttccaataattgcagctgctaatgctgatggcccaccttctctatttgtcttagctcctaagacagagtttgcaaagctcacagctgagctttcggcccaacttatatgctctccgaatcttggaaggtttccagttaaatagggcgtgcaagtgcaacttatctcaacttccatctttttaaatgcttcaataattctcaactgctttttggcaaacttctcatcaatgccaagctctctccatatatctaaatccattccagctgggtttaaagtggcatagaccttaactttaacatcttctttagcaaaatcttccaaaaactctaaaccaatatctttaatagttttgtatgaaactccagaaatttgagctgagcttatagggattagcttatcagctccataaatatctcccaaagaaactaataaattcatacatcttcttaaaacctctccatattctccatctaatattttctcttcttctttagttagatacatttttatccctcaaatttttactaaaaatctgattaaaaatagattacagtagggctgaatgtagtgaagccccgctctgggtatcccaatagggcgaagccctatgggttagatacatttttatccctacttttaatatttttcatatagaatacttttccatcatattctaattttattagttttccctcatttaccattttatttataatatcaaagctaatatttgatttatttaacaattctttaataacttcctctctcattggatgaacggaagttatagccaatatatcctcttcaacattttcagagaatataaattcatttccttcaaatttccctaagagtttaattttatttttaccaataatttcattaaatatggctaatattttagttataacttctattttaggaggttttatatatttttcagatggtggccttattggagtatttaaatagcatttatttggatttaattcttttaaaaattctgctgttttgattatagattcctctgtatattttatacttcctaaaatcatcgtttcagttatcaactctcctttatagttatctctaaaagctatcattccttctaagattttatctaacaccaaatctttatgaggtctatttatttctctccaaattttttcatcaacagaatcaaccttaaaagatactaaatcaaagtttaatatgtcatttctaacatcttccctccaaattaatgaagagtttgtaattattgctattggaatgtcaaaatctctaagcatttcaacttcttttgataaatttatatctaatgttggctctccatctgcaacaaaagtgaggtagtcaattttctcattatttagcttacctatcctctcctctactgacttaaaaatatcttctggactataaaactctctcctctctatagttttgtttatggttcttccaacttggcaatatacacaatcataactacaaaacttacatggaatgctatttatccctagactcttccctaacctccttgatggaactggtccaaatgctatagtcatagaaccaccaaaaataaataaaatataaaattattcctctattttctccttctcagccactttctcattaacgatttccaaatattcttttaatatttccttactcttcacagcatccctaatatttttattttctatgctaataactccatcatagccaatttcttttagcttttcaaggacttcaataaagttaatatttccttctcctattttcaaatgctcatcatcatagccgttattgtcgtgggcatgaacatgtataattccaattccaatattttgtagtttttcaacaaattcagctggatttccagcagtgtttgcgtgtcctatatcaaaagttatccctaaattctttgagtcaatgtctttaacaatctccaataatgattctggagttatccctaaaactcctctaaagtttggcatgttctccaaaccaatctttattccataatcttcagctatctctacaatctcagaaagtgttgagaaattgttatccagtatctcacttacatagttactccagagctctggaatatagccaggatgaactacaacaacctcagaatcaagctcaaaagcaccttctatagcgtctctaatacactcaactgttaatttcctaactctctcattcattgatgcagggtttaaatctgaaaaaggtgcatgcactacaatttcaacttcgtatctatctctcaattccatgagatactttatattctttggagataggtaatgagttccctcacagacaatctcccatgcatcaaagttgtgttcagctatcttctccattgatgaagttaagctctctggtaaaaaaactaatgatgaaacaccaaatttcatatctaacacccattttgattttttgtctaatttagttttacgcttcaaattaatatttatgtttttaatagcttttagctttttggttgctaacgtaatgtttatatactgttaaacctaatctgtcattaatgataatgataaattatttggtgaatagaatggattttcagatggcatcattcataacttctgggcttttagttattattggattatatggtgtgttttttgttgataatgttctgaaaaaaatcatagctttagagattttaggtagtggagttaatttagctttaattgcaattggttacaatggtggaacaatcccaataaaacttccgggtgtttctgtagaagtttttgctaaagaatctgcttatccattaactcatgcattagttttgacaaatatagttatagaggcatcaatgcttgctgtgatgcttggagtctctataattttgtataaaaaatataaaacactcagaagctctgtaatactaaaagaggattaattctatttaactttctctaaaagattggagggagaatatgaattatctgccgatgatgatagtgtttccattaatcatggcaataataatgaatttattgcatggaaaagagaaagcagtaaaatatataacatttattacagctgctattttgattattttgccatttatcagccagtatggttattattactttggtgggcatggagttgttaatggatgggtatctggtattgcctatctatataacccagcaaagcaggcaattattgtaactctgtctttaattgcctctcttgttttaattacaggaatgggagagaaattaaagaataatatgtttgttaccctctcattaatgggatttgcaagtattgcagctatagttttggctgatgatatattcaacttgtatgtgttctttgagatagtttcaattgtccaagctggattagtatttttatctggaactgaagaggcatataaagcaggattaagatatatgataatggggaatgttgcggcagccttaatgctattaggaatagcgttcttattagcttcaactggaactctaaacatcacagacatgaaacactatctgttagttgataatccaatgatttatggtggcttgttgttgctaattgttggtttagcttatggggctggattgccgccattccacaacgttaaagctgatttatacgcaaggtctaagggatttatctctgcaatgctccaaacatactcaaaatttgtgttagttggcttgatgataattattctaaaattatttaatggattagattattttgcaagtgctcatgctgttttaattgcattgggagttttggcaatggtatttggggttgtaatggcgttattgcaaagtgattataaaaagcttttggcatatcacgctataagtcaaggtggctatgtggctactggcttagctttaggaacaccattaggaattgttgctggtatcttccacgctataaatcacgttatttataaatctgccttgtttttgggggcgtatattgtaagctgtaagagaggaagtaatttgcataagttgggaggtttattgcctctaatgccctctgtggcatttatggttttatgtgcaaagcttgcgattagtggaattccaccatttaacggatttcagagtaagtggatgcttgcccaagcagctatgcaagtgaatatgccagaaatagctataataatgattattgttagtatagggacgtttgtctcaatgatgaaggcattctatttaatttacttaaaaccagttgatgaagaaactctgaaagagtatcaaaacaaggaagttcctaaacttgctgtctttagcttgtttgtattaactgctctatgcataataattggtctctatccagacattgtaacaaactatctctgggactatgcaaaggagttaggggttaattattatttaaaatagacaaaataacttaatttttggtggattttatggattataatgactttcaaaaaaagttggataaagaagagcatggggatggaatcacagttggagcagtttatactggagaatttactctctatttattgtttatatttggagctttgattattgggagagtttatggaaaaactttgatgactttgtttggtttagctgcattagctttctctctgtcagtgtctcctttaatctttaagtttaaggaagagaactcaaatgccataaactaccagttgttttggctctccatattcttgggggcaattgcattctgcatctatatgacaacaaggtggtaaaatgaactctaaaagagatttagctgttgccatatccttctttgtatttggggcatctgtattatatagtttagcacacatgcagattagtccaggagttaatgaagtttatctcactcactatataatcccaaactatgtgtgtgctgtaatatttgactggagggcttatgataccttgggagagtgtttggtcttagttgttgccgttatggtctcttggattgtgtttgggaaatcattatatgataacacctatctaaaagagttatttcacgctccagagtcagatgattacataacacttcaaggttggggagaatatacaccaataattaagtttttggcatttcctatgagtgttttaatggttgcattgggaattataactgtgttaggagggcatataacaccaggaggagggtttcaaggaggagctctaattgctgctgcatttatactatcagttatagcctttggttctaacagcccattatggtttgaccataaatttttggagaagttggaggcattgggagctttaggttatctattacttggtgttgctggaatgtttattggaggatattatttattcaacttcacagaaattaatggctttactatctttccagctccaaaagaaatcataacagctggaatcattccatatctaaacattgcagttggattaaaggttttagcagggttatctactgctgcattcttactgtcttgtgaaaaggttattattgaaaaaattagcaaatctgaggagaaattggaataaattggaataatggtgatttaaatgcttgatgcaatattatcaaactatttatattatccttcaattcttgcatttttgtttggagtgttgatgggagctaagtataggcataaaataggaaatatttttggatacttaattttaactgtagttatagcttatttcttaaaggcatttccatactatgacttacttcctttatcttgctcttatctatctgcagtaattggaataattattggaaacaggttatttggagggaaaatgatttaatttggtgaaataatggatgaaaaaatgttgaataatattttagatgaatttctacaaaaatgcaaacaaaaatttggagatgatttaatttcaattattttatttggttcttatgcaagaggcactgctgtggagtattcagatgttgatttattagttattgctaaaaatttaccaaaaagaaggattgacagacataaagttttaagggacatagtattagagtttatttatagatatgggattaacatttctccaatattggtagagccaagggatttatcactgaagagtataaatccgttgatttgtggtattttaactggatataaaataatatatgatagagataacttctggaaaaattaccttgagagaataaaaccgattattaaaagaataaagccaatatttatcgatgaggagaaagaatggaagatagcggatttaatataaagtatgctaagctattcataaaaagggcggaagaggatttagaagtggcaaaagttctactaaaaacaaatcactatccagattcagtctatcactcccaacaatgtgttgaaaaagctgtaaaagcagttttaattttaaatggaattattttcagaagacatgtagtttcaggagtgtttaggaatgtcatctacgagatgaaaattgaggattcatggaaagagaaattactaaatctaataccaaaaatagaaagcttagaagaacattgggttatgccaaggtatccagaaccgtattttggagaactttggaatccattggaagaatatactaaagaagatgctgaagaatgtttaaaagatgctgaaaatgtgttggaagtaattaaagactttttaaaagagaaatatggcttaaaacaaatttgaggggaggaaggatgattataactatattagatgaatgtagggtagaggagaaatgccaatcctgtcctttctcacaaacatccaagtgtatggaagcttgtccaacagatgcaatatttttattaaataataaaagttttagctgtttaacatgcggagagtgtgcaagaaactgcccaaacaaggcaattaagaggaatgagtttggaggctattatgtagatagaaggagatgtaacggttgcggtatatgtgccaacgtctgcccaattggaattataaagattgtagagaaagatggaaaaaaattcccaatgggaatttgctcaatgtgtggcgtctgtgttgaggtttgcccttacaatgcaagagttagctcttatgaattgttaaacacaaagagagaaggcttagcagagagatacttaaaagttttagagaatcttatgaaagttaaattatttagagctgaagaaaaaccaggaaaagttgttgaaaaagtagaaaggaaatctattaaaattgatagagataaatgcgttggatgcttaagatgctcttatttatgtccaagagatactatagtcccagattctatagatgcatgcacatcctgcaatttgtgtggagagaactgcccaaaagatgccattaaagatggagaagtagattataataaatgcattctctgtttaaaatgtgttgaaatctgccctaacgatgctttaaaagttgaaaactttaaagttattaaagttaaggaagataaaacatcccaaccaacaagttattgtataaattgtgggttgtgtgctgaacactgcccaagtggagctttaaggtttgagaatggacatctatattacagcccagatgtttgttggaaatgtatggaatgcgttaaaatctgccctaacgatgttagaagaattaaacaggactttcgcagattatacatccataaaggaaatttgatgccaaaggcatctatgggcaataataaactttactcctgcgaaagtcctgtagatgatagagttgttggaggctgctctctatgtgaaatttgtataaataactgtccagaagaagcaatatcaataacaacagttaaattggagaaaattaaagatgaaaactgcatactctgtggaacatgctcaaatgtatgtccaagagacgctataataatagacagaagtaatggagaggttttatttactgataattgcatagcttgtgaaacatgtgctattcactgcccaagagatgtgattccaaacacaactggctataaaaaggttgttgatagagaaaactcatttattagaactgatatggacttctgtataaagtgtggtctctgcaacaaggtctgcccaaataattgcattgattatggagttattgataaagagagatgtgagttctgtggagcttgctacaatatttgcccaactaaagcgatatatctacatagaaaatggaaagtgaaagaataaaattttggtgattgagttggctgaactaaagaactttgccaagatatttttaaccgggatatatgaaaatttggagagaattatctttgggtctggaagatacacaagcttagagatgagaaacgctatactaactggaactgttaagattccaaaaaccgttattgaagaactctgcattggttgtgagggatgtgccaacgtctgcccaactaaggcaattgagatgattccaattgagcccgttaaaataacagataactatgttaaagataaaataccaaaaattaatccagaaaaatgtgtatattgcctatattgccatgacttctgcccagttttttctgtgtttaatgaaatatctccaatacatccaagagatgttggtgaagaatatatagagattgatatatcaaaattgttacagaaaaaaattgagatttctgaggagcaaattaataagattagctcattgttatcaattaatttgaggagaattattaaggattaaatttactatatattctcattttataatgggaattttggtgatttttatgaaattcttcaatagagagaaagaaattcataaaatcttatctattatagaaggagaaccaaatttgatttatttcatctatggctccataaatagtggaaaaactgccttaataaatgagattattaacaatagattagataaaaataaatacattgtgttttattttgatttgagggagatttttatctctaaatacgatgatttcattgaagttttgtttgaggaatatgaaggagataaaagccctatagaagtaattaaggcaattatcaatgacttaccttcattgtatggcattcccataccaaaaaatactctaaacgagatttttaaaaagaaaacaactaaaaatgtttttagatatataaccaatgttttaatggacattaaaagagaaggaaagcaaccaataattattattgatgaacttcaaaagattggagacatgaaaattaatggattcttaatctatgagctatttaattactttgtatctctaaccaagcataaacacctatgccacgttttctgcctaagttcagatagcttattcatagagagagtttataatgaagcaatgttggaggatagagttgattatattttggtggatgaccatagagggggctacgccccctctattggtatactcccccagatagaaagtggggttgcctttggcaaccccgctctggagtatagcaatagaggctttgcctctatgcgaggtgaatatatcttagtggatgattttgataaggaaactgccttaaaatttatggattttttggctaaagagaataacatgagcttaactaatgaagataaagagttaatctataattatgtagggggaaaaccagttttaataataaaagttattgataagttgagatatgaaaatttaaacgatattttagattttatgcttaaggatgctactcaaaagttaaaatatttcttagaggatgttaaagaagaagatgaggaactttataaaaaagttgttgatgcattaaaattatttaaagaagattatgaaatagaggatataaaaatacctaaaaaaattagagagtttttaattaaaagaaatatcttattcttaaatccaatagaagggattttaaagcctcagagttttttagtttggaatgctataaagaaggtgttataaaataatagaaaataactattcattatttactagtcggcttcctttatagcatcatataaggaatcatatagataaataatctcctcgaaacttttagaaaaagtttcattaaaactcgtccatttaaccaattatcaaagttttataattaaataaggcacttatagaagccctttgggcttctaaatattccttaattagataatttagctttgataattggttataagttagggctttcagccctaattaatgtccattattacaggtcagcttcctttatagcttcatacaacgcatcgcatagataaataatctctttctcagttattgacaatggtgggactaagataataacattaccaattggtctcatgtagatacctttttctaacagcttttcagcaactctgtagccagctttataaccgtaagggtagggttctttagtctctttatcttttacaagctctattccgaccataaaaccccttcctctaacatctccaacatgctcaagttcctttaatttccttaattctttatggaagagctttatttttggttggatattctctatcacattctccttctcaaaaatctctaatgttgctaatgcagcagagcatagaagttggtttccagtgtatgtatgaccatgatagagttgcttactctctccaaactctcctaagaattggttatagatttcatcagttgttagagttgccgctaatggcaaatagcctccagttaatccctttccaagacaaaggatatctggcttctccaacttttttagctcttcattatcacagaaaaacatcttcccagttcttccaaatccagtagctacctcatcgaggataaagattacatcattctccttacatgcctttgcaactccttcaatatatccatctggatatggaatcattccagcagaacccataattcctccttcaaggataacacaaaatacttcctcagcatgtttttcaattaaactaatcatctcatttaaacattccatttcacaacctttttcatttctctcatcagtatctttaaagttgtggtatttgcatctgtagcagtaaggaggatttgcatgatagcctttaaacaataaaggcttaaaaaccccatggaataattcactccccccaacactcattgctccaacagtgtccccatgatagccttctttaactgaaataaatttagttcttcccttatctcctcttaaaacataatattgataagccattttaattgctatttcaactgcctctgctccatcttcagagtaaaatacctttgttaaatgctttggagttatatccaccaatttttttgccaataaaattgatgggacgtttccacagcctaaaagtgttgaatggcagattttatcagcttgattttttattgcttcaattatctcctttctactatgtccaaatagattacaccatatagatgaaacagcatccaaatacttatttccataaatgtcaattaaataattgccctctcctctctcaataatcaagttttttgattctctatattctttcatctgtgtgtatggatgccaaatatattctttatcccatttttcaagtaaatttttatcaatgttcattttattcacctcaaaatcttttcaaaatcaatctcaaaatcttccctacttttaacaatcccaattatttcaatgttcccaactttttctattgtttcaaaggttttttcataatataaaacttcacttaaatcagttatacagttaataataactcctctaacgttaattcctttattccttaaatgttcaacagttaatagtgtgtggtttatagtccctaaattaggtcttgaaacaacaactgcatctaatcctaaaaacttaatcaaatcactcattaaaaaatcttcttttattggaacgcaaactcctccagctccttcaacaatcaaaaaatcatatttttcttttaaagtttcataagcattttttattttctcttttatctcatccaaagttaaaggggagttttcaacgtcaaacgcaatatttggagataggggaagttttaaattaataggattcattaaatccaaatcatcatctgtatttaaaatattttttaaagttagagtgtcttctctccctcctgtctcaaccggctttaaatatccaacgttaatgcccatttttttcaaattctctgctaaaattgatgaaacgtaagttttccctataccagtgtctgttccagttataaatatcattttatcacctatcaaaatttttaatctactgtttaaataacttaccacaaaatgataatcgtaattattataattacaattatcattgatataggaaaccaaataaatgcttattttatttaataaaaactaaaaaagagaaatatcagtcactactataaacctctttaatcctctcacacaacagttcaaaatcctctttttcatgcccaacatttatgctaacccttatcctctccaatcccttaggaacagttggatatctaattcctacacaaaagatattattttttattaaatgttctgctatttccatggttttttctttaaaaataaatggatagattggagttaagttatcttctttaataaattcatattttttaaaaactttatttgctatttttatgtttttttgaagctttttaactatatctgttttttcaataatctcaaaggccttaatgcaaccctcaactacatgaggaggtagagcagttgagaatataaaactcctcgaagtgtttattaaatactctacaacctcctcaattccacagacaaagcctcctaaaccaccaattgctttagataaagttccaatttgcactatgttgtcagaaggttttaaattaaagtgctttaatgttcctctcccatctcctaaaactccagtgccgtgtgcgtcatcaataattaaaatggcattaaattcatcagctatcttctttaaatccctcaaaggagctatatccccatccatactaaaaactccatcagttacaataaagaggttgttatatttcccccaattctcttcaattaagttggttaaatgctcaacatcgcaatgattgtaaattaaaacatctgctttactcaacttgcaaccatcaatgatagaggcatgattaagcttatcactcaaaattaaatctccttttttgcacaatgcagagataactccaacattcgttgcatagccggatgaataaactaaagtcctctccgtctctttaaattcagctatcttctcctccaatctttgatggtttatatttccagaagttaatcttgagccggttgaaccagccccatattttagcccttctttaactgcttcaataacctctggatgctttgataggcatagataatcatttgaagagaaatctaaaactccatcatcttttttccttaaaaatctatataatccgttgttctttataatttcaatctctcttcttaatttctccctaaacataaaaatccctttttattttataataaatggtttgttttctaatttgttgattaaatcctctatatcaacatcatctttaacaaaaaatacccttcctccactttctccctctttttttaaatttgtaattctaaagtatccctttttagttgctacatagccagttgtgtagcttttattatccgatgtgcagagttctgcaataactcccaaatgaataaccttagatgctatggcaatggcatcgacagttctttctgtccctaaattttcttttaaaatcttctctttcaattcctttgttgtatctatgtttttaactctaactcctctctccttatctggctctaacctctctccctttaaatttaaaattgctgctcctctcattccccctttatcaataatctcataagcataatctataacgctatctgggatgccttcatttcttaatattttctttgccgtttctcttgcctcttctttatctttacagtgtattgtttttattggcaagtggttaatgtatgttatctcttctttaatctcttcaatctttatatttataaagtctggagttccattttcatgagttaaagcccttcttacaagctccttaacagtctcttcaatctcatctttatttacaattctctcagctccagagatgtgttttccattcttcgatgccctcatctttatactatacataacaatcaccaataaattttaaaagttaatgtttatttattgtatatagggtgatttttatggagattgaaacttttttaaaaaaatctctaaagaacaaaatagattttgatgatgccctctatttatataataacttcagtgctatagatttgttatatttggcttttaaaataaaaaataggataaaaaataatagcaaaattaaattatgtgctataataaatgcaaaaagtggaaaatgcaaagaggattgtattttctgctctcaatcaatttatagtaaatgcaacatcccaatatatccattaaaatctaaaaaggagattttagagtatgctaaaaaaatcatcgatgaatgttctaaaatttcctcatccatagaacgtgggacattaattggggctgaaagccccaacttaatggacgtggggtatcccaatagggggtttcccctatgggtagagagattcagtatagtaacaagtggcaaaaaaattaatgatgatgaattcattgaaattgttgaagctatagagcttataaaggaagaaacaaatttaaaagtgtgctgttctttgggtttattggatagagaaaaattaaaagaactaaaaaaattggacgttaggattcacaataacttagaggcatcaaaaaactactttaaaaatatctgttcaactcatagctatgaagataaagtaaaagttataaaagaggcaaaaaaacttgacttagaggtttgtagtggtggaatatttggacttggagagagcgtagaggagagaataaagatggcttttgaacttaaagagttaggggttgatagcgttccaataaatattttacatccaattgaaggaactaaagcttatgaaaaaataaaaaatggagagattaagccaataagtgtctcagatgctttgaaattgatagcgttatataaaataattatgccttatgcagagattagattggctggtgggagaatatacaacttaagagacttccaatcttatgccttaatggtcttagacggattaatggttgggaattatttaactacaaagggaagatgtttagaggatgatttaaagatgattgctgatttccacagtttataaaatgaggtgatattttgagatttgattttcatacgcatacggtttttagtgatggagagctaattcctgctgaattagttagaagggcaagggtcttaaaacatagggctatagctataacagaccatgctgattttagtaactacaaagagcttatagaaaaaacaacaatcgctaaggaagagctaaaaaaatactgggatgatatcatagttattgttggtgttgagctaacccacatcccaccaaaatctataccaaagatggctaaaaaagctaaagacttaggggctgagattgtcgttgttcatggggagacggtagttgagccagttgaggaaaaaactaattactatgcctcaatatctgaggatgttgatatcttagcccatcctggctttattgataaagaaactgctgaaaatttgaaggagaatgatatatttgttgagataacttcaaggagaggacataacataactaacggctatgtggctaatatagcaagggagtttggattaaaaactttgataaatactgacacccatgctccagaggatttaatagatgatgagtttgcaaaaaaggttggtttaggggcaggattaaccaataaagagttggaaaatactttattgcattatccaaaggagcttttaaagagaatttgaggtgaaagaatgaaaatctccgatgttgttgttgaattatttagagaggcagctatttatctaccagaagatgtaaaaaatgctttagaagaagcatataaaaaagaaagtagtgaaatatcaaaaaacacattaaaagcaatcatagaaaataacaaaatagctgaagaaacgcaagttcctctatgtcaagatactggtgtcccaatagtatttttgaaaattggaaagaatataaattcatcagaaataatgaaaatcattgaagaaataaaagaaggagtaaaaaaagcaacggaagaggttcctttaagacctaatgtagttcatcctttaacaagagagaattttaaaacaaatgttggcttaaattccccattcataaatattgagtttgatgaaagcttagatagagagattgagataattgcatttccaaaaggggcaggaagcgaaaacatgagtgctttaaagatgttaaagccctctgatggaatagaggggataaaaaactttgttttagaaacaattgcaaatgctggaggaaagccatgtcctccaatagttgttggaataggcattgggggaactgctgatgtagcattaaaattagctaaaaaagcactgctaagaaaaataggagagagacatagggataaagaaatagctaatcttgaaaaagagttgttagaaaaaataaatagcttaggaattggagcaatgggtttaggaggggatataactgctttagatgtttttattgagattgctggatgccatacagcttctttacctgtaggaatttgtattcaatgctgggcagatagaagggcaattaaaagaataaaattggatgctaaattataagtgtctttcaaacttcttagataactaacgcactaataaacgccttcctttggaggtgttcaaaccttcttcaataaattttattgatttgaaaaaaatagaataaattacatctcctttttaatatctactactaaaaaccctccaattgataagttttctggtttatatataatgaaatattgccctggaacttcattctctggtattttgaataatccaaggtatttattttttccagtttttattaattctattttgtattttttatttgttggggatagtatatacaaattattgccaatatctatctcagaagatatttcaattcttactgtgtcccctaatgaataaattacatcagatatatagatttttggaggttttggtagttttatggtttcttttttcttaggtttaggtttttctttaatttttaatttatagagaatggatgcaattatagatattacctttggacgtgttggttcatacattaataagccgattattgttataatcaatccaataacgaataggattattaaatcctttattaaatttagcaaatatgggtagggcgatattttttctttaatgaatattttatttaagttttcaatattaaatggtagatattcatcgaaacctgtaatttttataagagcatatactatttctaaatctttagagagatttgtaaaatcatatttactagttctatttacctcagttttaatatttggtggtagggtgatattatttttaatttcatttgtttcctttctggttttatttgtcatttttcctttttcagtttggttgtatattttagtttcgtttgttatattaattatatttgttaactactgtttcattaatagaagttttaattttatttaattttttgaaataaaatgtttttttgaatttttttatcgttgatatattattaagtagttcaatgcttacagttatattgtttctatctttcccaacataaaacggaacttttgtctctttatatgggtagattgttattattttggaatatttacctattgtagcattaacctttataggaacttgataattatgagatagtgttagatttgcccaagggtctgaaggattgtattctaaaccaaatactaccggataggtgaccataattggtttataatatagaggaataactgcctccccagttttagcatatattattaaatatccctctaatgagtcattgaataaaatttcaagattaacttttctataatttccgtaaatatcgatggttttctttttactacagtttattaatctgccattttcatccattgcagaagcccagatttctatatcttttaaatctggaacagcactttttagagaaactgtaacattaacaggatatccaacaattggctcatacttcacaaatccctgcgttctatttcttatttttataaagacagtgtaattgtgcagatatacatcctcacaagcaattattggtcttgatttaataatccttgttactacacactctctaactcccatatttgtagcaacgtgtatgtagatagggccgtngtattcctttaaaaatagcgtttttatatttacaggaatctcttccattgttccaatttttaaatacttctcttcaaaatargtatattttttaatatcgtctgggactgttatatatactcttgtctcaacgcatcttccaacgactttctttaagctaaaagataaattttgaggatatccaacaaatatctcatcatttaagttactgcatagataaactggtggagttggaattaaagataaatttatacttatatttttcttaatgatgtagtatttttcataaggtggagttatagcagtaactataaatttgagtttaatttttccatcgtgagataaatcttttgcattaatttttaatccactaaatttaataatatttacgcaacttttgttaagctccacttcttttgagtaggttttattataaatatcctttatcgatatattcgcatatatctttttatttaagttatttgttacattaacataaacatcatagaatatgctttcatcaacaaaatagtaatgttctggataattctttacttctaaactatttatctttattggcttagtaaatgttttataataaaaactttccatatttccagttttacataacacaaatattgtgaaattttcatcataagggtttaacgctgatgtattaagtttaactggaattgagtatccatcattaaattcttttgctaaaaagtatttatttattgttttattatttaatatgagataattatctccctcttttttacatagaaatacctgtagagttccataaacatcataatcaactgtattattcacatcaacatcaaaccagtttgaatatgcatagtccccatattcatcctcacatctaacattatatacatacagtgggcaagctatttctacattatagacctttatctcatctccaaatagagattttaaaattacagtattacctttaactgttttttcagttgaataatgattatcactaactgcctttactgttatcgtgtattttccagaatagtaaaaattaacttttatgggaattataattttggattttggaggaacataaacgttaggcgtccaagattttattattaagccatttgacggaggatttgattttattattttgttgtctttaatgatgtaataagttccttgtaaagatgccgtaaatgaaatattaacatagtgaggaacataatcgttgtttcttatagttacatatacaaaatcgtaaaaaggaggatatgggtagggacatatttcaaactctaaaccctctatctctatctttttagttacttcttcttcaggaactggaactttgctgttatatgcataggttatatttatttttttataaaaagtataggttatattattactttttattgttacaaatactgtatgaactcctttttcattaaacaccatcttctttctaataaacattagagaatattttgggattgagtaattaaacatctccacttgcgtatctattttgttgtctatatatccaattattgatatatttgcattaatgttattatctggattacttactgttattattagatattgcgagctatcgctgtaatcaatatcctttatctctaagccattaactgtgattaatgctaaagacagtgcaaataataatacgatatatttgaatttcataaatgtgacacctaattttatatattgtaatgtgctatgtaataataatgtttaaatatatatgccataataccgcatttatatttaaaatatcatactacaataatcaaataattaataaattttttatagttaagataatcttaaatatcataaaatttactttattgcccatatacataaacacttacataaacttaatggtgaagtttaatgaacaagtcgggaatgtccctaataattacaatgttattattaataggaactgcaattgtcatcggtgcagcttattacgcttggagtaacaaggtatttagcgacactaccgaaaaaataaccccaacaataaagtcatcgatagggaatatcataaaacctattgaaatttctacaattgaaacatactattttacaaatcttgatttaaatggagattcccggataacaaataacccagaggagcgatttattcaaacaataaaattagnatttataaacaatattgatgaagatttaaatgnaaatacaagaatatactgcttaactccaaatgtttcctgggcatcagtaaatatagatgatagcagtaacaatttattgttggatagagatgaaaacccttacaattatagcggacaatatgtttattttaatggaacagtgtattattcctcaatgaaattttatgatgaaaatggaaaactattctatgctgctgcttctaatggaaacgcattgaatacttcaaatttgcttgatttaattgatttaaattgtccaacagagagttttttattgaaggggaattctaaaacagatataaattattacatcctaataaataatacaaaagttccaaatacaataatatttgaaatcattgcttcaacgaaatatggagacgtagagaaaaaaataacatttgaaattagttaaaaaggtgatagtatgaaaaaggcaatttatttgttaattttatgtatttttggattattctctgtttattttacttatgctgagaatatttcagatatttcaaacacaacctctaaaaacatctcaagttcaaatatttctcacaataatataatctacagtaatataaactacaacgnaattctatatattattgtaaaaaacaatactgcctatgttaaagatgtaataaatgggacaaacaatccatatcacataaaatccgctggaattattttgtatgagaaaatatatggatacaactattctaatttactatatagaaactcttcaaattctcttatattctactacaattttagtgttgataaaataaattacacaataaacataacgattcctcaaattgaagattatgttggctcccttggaggaccaattagaatgaggattccaccaaataatgtgaaaataatcatagtggcggaaaataaattggctgagacgaatggaaaatatatcttagagtataataaaacagataaaaaagttataagtttgatttatttagataatgtctcctcaatttgtaatatttattatacaaagttcttcaatagttcagaattttatggatatgcagtagcaaatgttacatcaattacagaaaataggacatcttacactatcaaaaacccaaaagggacatttacatttgatagaaaatataatgtttttgtttcaaataaaactgcctatttaaaagagccgtatttgtatgtaaaactttataattcgacaattgatgatataataatattagaaaataataaaatctctgaaaactctacgaaattcatgagtaattatttattaagctttattggaattattataggttttgggataataggattggctatttatttgagtaaaaggggaagaaaatgaatacatatctatctactcttttagttttaactacaatctttgcattatcaattattgcctatgaatggggaattaacataatagacaccactttaaatcaggtttcaaaagaaaaagaaaaaaatcgtatagaaattataaaaaatctaataaatgatgtaatatacagtggtgtagattcagaaaggacatttgatgaaactaagattactttaaaagaaaataatgttaaaatttctaatgggacaaagtatgtatcattcaatatcacaaccattgaaggaattgattatgatgtttatcttgaaaaaggaacattatatatctttatctacaacatctccgctcaatgtccaaatgtttattatatcaaatatacaaatctatcaatttatgagtttggaggaaatataacaataaactactccgataatttgaggcatttctatgttaataactcaaaggtttatgtttatagcttattgatgggataaatatgcatattattgcaaaatccattcttcttatggcagtttcatttttggttattatatttacctctacaatttactctgaattaattgaaattggaaaatataggtatattgacaaggttgatagggaaataacttcagaagttatgaatgcagtagttttagcaaatgaggggaatataactctctacaaaaaaataaacctaaattgcaaggtcatatttgaaaataattcatttacaataattttccaaaataaaacctatgttcataagtttaataacaacattagattctttaaaaatgagatttctgacatttctaaaatctcatgtaaaaaggtcaataacacctatatgatttatatagagtgatatttatggtaataaagaaaatatttggtgaaaattttaattttaacaaaaatatagacattaaaaaaatttttaaattagacaaaaatgtaaaaaaggatagagaggaaaatgaaagttatttggatgctttaaaagagatttatgaagaaattaaaaatcttgaaatttatgaaaaaatgacgattggtatggcggagattataattggttatgataatgtagaaaaaacaaaaaagtatattgttattgagccaattctaacaaaagaagagataaaactatttttaaaactaagaaaagttgttcaggcattattggatgttccagttgaagaaatagacaaagaaaagttggaggattatttaaaagaaaaaattaaagaaatttttgacgatttaaaattaacattggatgatgtaacaagacataagttaatttactttttaattaaatacctcattggatatgggaaaatagatgctcttatgaaagatgagaatttggaggatatcagttgcacaggtgttggaaagccagtgtatgtgtttcatagaaaatacgaacatttaaagacaaatataaaatttgaaactgatgaagaattagactcgttttgtatatccttagcccaaaggtgtggaaaatctttaacattggctaatccaatagtggatggttctctcccagatggtagcaggctaaatgtaacccttggaagggatatctcagrtatggttcaacatttacaataagaaaattcacacacactcctatattgccaacagatttaataagatatgggagtatttctccagagatgcttgcatatctttggttactcattgaatataaaaattctattatggttgctggagaggtagctactggaaaaaccacccttttaaatgcattctctcttttcatccctcctcaaatgaaaatcgtatctattgaggatactccagaaattaggttgtatcatgaaaactggattgctggaactacaagaagtggattcggtggagaagaatatgaaataactatgatggatttattaaaagcggctttaaggcaaagaccagattatttaattgttggagaggttagaggtgaggaggcgaagatattatttcaagcaataactacaggacatttggcgttatcaacgatacacgcaaaatccccagaggcagttataaggaggttgaatgctgaaccaatgaacattccaaagattatgcttgaacaactaaatgccatatgtatgcaggttagattgatttataaaggaagatttgttagaagaactaagagtataactgagattgttgaatacgacccaaaaattgatgatattatattacatgatgtttttaggtggaatcctgaagatgatacatttgaattttctggagaaagttatttgttaagaagaatagctgagttcattggaatttcagaaaaagagattattaatgaacttcatagtagagcagaatttttgaggaatttatgtaaaacaaaaccaaattttgaagaatttgttaaaaagatatgtgagtataaagaatatcataaaggtgattgaattggatttttttgccaatttaaagttaaggtattataaattggctatgaaactttttaaaatagaggatgagaaatttgatgaaattttattaaaagcaggtatgaatgcagtttcttccacatatctgcctgtagtatttttaacatctataatattagggttaattatcttcataatttttttaatagtatttaatatattctatgcaatttttgggcttattggagggatttttattgttattcttattggggtcttatatccttatgtcttagctgaagaaaaggctaaaagtatagatgagaatttaccttatgcgtttgcctttatctctgccttatcttcagcaaacattcctgtagtggagatatttacttctctatcaaaagaggatatttatggagggatgagtaaagaggcaaaagaaatagttaaggatacgaaggtattcaattatgacattataacaacatttttaagaagagcaaggataacaccaagtaaaaagctgtcttcagtttattataatatagtagcctctttaatagttggggctgagatgaaaaacatttttcatgaaatatatgaacgattgatggaagatagaaagttggaattatttgaagctattgaaaaagttgagatactgtctgagttttatgtaatagcatgtggtatgattcctctttttgttgttatgacagttcctgtagcttcatccattagtgcaattttacaaaccgcatcactttttggagacccaaagctacttccactgaccttttatttatgggttccaatagcatcaataatttttatgggattggtttatggaatactaccaaaagacttcaaattaaatgtttctttattagatgttttaaaagaatttgatgaaccagagatagaaggcataaaaatgaaatttaaatggaaaccagttcattttattactttgtttttttggatgctttctataatttcttttatgttgtttttcattagaaaatcaatttttaagttccatggaactgatttcttaatgtttggaattttgtttcttatacttccttttattttaacaagctattggcattttattattgaaaatcaaaaggagagatactaccctatatttttaaatgatttaaccatggctgtgagaagtggtatggatataattagagcgatgcaggtctgtgcaagaacgaactatgggcctttaacaaaaattgttaaaaaaatggctattcagatgtcttggggaaggcctgtgaatgaagtatttgccgatttagaaagaacagaaaaatctttaattgcaaaaagaatcgcctcaatattaaaagaatgtgccgtctctggtggggatgtaaaggatatcttaacctcagttacggttcatgcatacaagttaagtgaaatgaaaagggagataagtgcaaggcagtttatatatgtggttgtcatctatctctcatttttcctgtacattgggacatcgtacattatggttcattccctcctgccaacattattaaaaaatattcatggtttgagtgttgaattttataaaaactatttattccaaggaattttgatatattccatattctctggagcttctttaggaatacttactgagaggtcgattattgctggaataaagcatatattactaatgttgattgttggatatatgctgtttaaattttacattgggggataataaatggaattggactatttacttgcaacagccatgtttttaattgtatgtgtctatgttatatctgaaaccgttaatttacatagtgtttatgatattgaagaagctaaaaaagagtttttaatgtattataatgatttaaaatataattattcaatttcaaagggagatttaatttttaattttaaagttaataaaataggatatgttattgagggatttgtattcaaagacacatctgaaagtagagagttaataaagtatcttgaaaacttgaatggctcatacattattgcatactccccttctaaggatgaattcattataacaaaaaatcatgagtttttaagaattatagggcattataatatttctgcaaaatacaaaaaaggagagtatggggatattgagataatatatccaaaaaactattctatcaactatagggaattccaaggtattagttgtaataagttgtttgaagttccgttctatatagttgataaaaatgaaaacataactctcaaatactacggcattttagaagtgggaagatgatacttaacaataaagggtttattagaatcttagaagctacaattgcaggtattatggttatattagttttttcttatttggtaatgtcccagaattttgattataatctttctttagaatttattggatataatgcattatactctgcacatattgaggagggggattttgaaaatatctcctccctctacaaaaaaattgaactgccaagtaatgtaggttatggatttgagatttacaaaaatgggaatttaatttattctgatgcaaaaaatggagttgttgttgagagaaattttatatttgagaataacacctcagtaaatttttataagttaaggttgatattatggtggagatgaataaaagagggcagttttttattattggtggagttattttatccattggattaatattgtttttcttacttggttttaactcctatacttctgatggctcttatttaacagtatttaaaatgaaagatgtcaaaaactctatagaaagctgtttaataaactctttaacttcaaactcaaatttaagtaaaaatttagacatgctaaaaaataattataaagatgaaggcattgaaattaattacaaaaaaataatattttctaatataagatatgaggcaaaaaacttaacattcaatttttcactatacaatggaaatttttcttataacatatcaaattatggatttggaggggcatttaacggaagtttaaacgtatcaaattatgtattcagcaagaatctattgttaaatatctctgaaaatggctcagttactgggagttttaatataactggaagttatgttaatgtatttgtttatgatagatttggaaatttgatacttaatgaaaccatttataataattccaatgaaaaatcgttatattattatatcttaaatgtatcaaaagaagggattttgctatatttattatggcaaaggatgtttttaacaactcattggcagaaaatgtatcctttataaatacaagtggatattacaataactctgagaatgtaacatatataaacatgtcaatgaatggaagcttttctggaatattatatgttaaaagttcatataaaaactatactataacaattaatgaaagcggtaattttgtctttaatgatacaacttcgccaattgaagttgagttgttaaataactattcagatgtaattcttaactataatcttaatgagagtataaacaattttagtgacacttcttatctcatcctaaatgaatcctgcaaaaatagctatttcaatgtcatttatggtaattcaccaatgctttatgtttctttgcatgatgaagattttaatcacaacataacaatttttaatccacaaaaaggaatatcttctaagggatttgttttgacagatatttttataacgactccaaggatgttttattcatctttaaataattcttttgaatatcaaagctggaacattaattaatttggtggaagtatggatttgggttatttatatgggttgatttgctcaatatatggggcagttgaggattggagaaaaagagaggttactgactttttatggatatctatgctctgggtaggagtttttattcatctcctatataataaaagtttattactattttttattgagatttttgctgttttatttattaccctatctgttagatatgaaaagtttaataagttagtttatattggagtgtttttatttttattgtcatttattttgtttaaatcatactttgcgttatcttttttagtattttatttgattggaatttttttatactaccttaattttatgggaggaggagattgtaaatttttaatggggctgagttatttaaaagggatgttctttaccttcattatttttttaaatgcaatactttttgtcatcccctactgtatatttatcttattaataaacctaaaaaatggaaatcataaaagattaaagttaaagaatttaccattattgtttatagctttaaaaaaagatatagacaaagttaaaaaatttgagaccattatgggggatgatgaaaacctttccttaattcccaatataaatgaagaaaaggaagagaaaaaaacatacaaaggaaaagtttgggttactcctcaactcccttttttggttttcatatgtctttcttatattttgtatattgtctctccttttccgttgatttttaaagtaatagaattagttattaaatctcatttctaagaggtttattaaatccccatatattgcaattcctggaacttctttttcttttattaattttatgccatccctttcttttacaactctaaacattacaatgctggcgattctcaaattgtcttcaaatgtttgggcagtatattcgttaattggaatcaaatatggctgttggtctataacaaagtatgtattatctattttcacagcaactgaagcatgataggatgagatttttaatgatgaggtattatataaagcaacatctaacatataagggattatattatcatttagcaatagagcggaggttaatgtggcgtaatctaaacaaactcctttttttgtttttaccgtttctgatggggtattgtactcatcccagctaaattttccactttctatttttttacacttatcataatcatactttatgttgtttgctacccactttgctatattttcaatagtagcctttttatcctttccttttaatttataagatagggatttaactttttcaatttcttttggtgttaatatatttttttcaataaagtctctaaaatattcactattaagagacgtgctgtaaatattaactttgtttgaggtttcacatataattgggttttctggaatgtcgtttagattagcaaatgttattattgatgcataagttccctgtatatcagaaccagctaatagaatgactgtatgtccatttattatctgtttttcaataatccctttattttttcctggaaaggttttatttatttttattttaaagaatccaatgtatttttttgttaaaggattttcttctggattgccaactaatattgtatcttttgtaattgttgttttgttatctgcgtttaagggggttataatctctgcagtttttacaaatttttgaagttcaacagatgttaatgtgtagtagcaaacatgattaacatcatagattttttcataagcgtagatattttggagtattaaaaatataaaaaatattaaaataatcttcctcattctatcaccgaggttgtcaagttagtgatttcacccaattatagaacatcatgaagctttttatccaactaacaaccgtatcgaatttactattacttggaaatctatttaaaacctctttaatcttatgataataaattctaatcgattcgtgacttatatcttcgaatttggagggggataaaccactttcctcaatgataatccgaggtagtataaaagccctgctaagattttaacctctatcgattcctattccttttaaaaagcttcctctctacgattctctcctttataacttctatcgtgagcctcatagtttattattttttatcaatatttaataaaaacttaacttaacaatctcataaacaatatcacaatataaatattgtttttttattaaaatagtaatatgtattgttatatcataatgttaatgaggaggctttgccttcgagacgaaatgttgatactaaatattaacgaagtttggattttggggctgtatctgttcagtcctaagtctgatgaactcatagtgaagggaatggtgctcccgatgaagctatgggctgaggacaacccatttccatagcttaccgattcgtatagtaagttattaaatgctatggtaagctatggaaacgggaaacagtattcatcactacattatgtattttaaaatgtttgcaaaaaattacatatgtattttattaccaattagttccaaatagatagagcttgttgtttgttgtataaaccctaaactctacacgtccattttttgaatccccactatctcctctataaatatactttccagcaaatgggacacttatgctataatatttatcataaatttcatcgtaatatacattttttggctcgaatttaactatatatattgaatttccattttcgtcatatacagagttcccttctgcatcttttttagcttcaaactctatattgtaggtttttatccatccatctccagccacttccacttgtgtcccaagccaattgtagttatgacatattgacaatccagtaactccatcaatatttaagccaccttcatagtttcttgcaatatagtaaatatccgaattatctgattcagatttaatttttatatctgtataatataccttacttccatcataatataccaataatccagaacctgtatcaaaagcataacattcaatatttgtttttaaagagtcagttattttaaactcatctggctctcttttataaacagttattatataaagcccattttctgttgccactattatataattcctaaaatcacttcttgcatctattatattaccattaaactcaaactccttaatttgcacaggtgggaatggttcatcaaatccatcttcatatttactgttataagcccaatcttcaaacttatctttctccatagtaattaagtaaagtttatttcctttccaaccaataactattttgtaattatttttattatcctctgctccagccatcaattcatcaacatccacatttgctaccacaacatcttttttaattttagctaaatcaatttcaacatttcctgttttatccattattgtttcttttggacagtcaaatattacatgatgcaactttccattatcatcctctataaaccaccccgctccataaaagtcatcacatactgcttttacattgtaaggcatttctattaaaattatgtcatcaacatcggcatcgaatcccatattatcgttatatgtgaaatatccatactctcctccactaaatccaaaacaccatattttatttccatctataattattggatttctaaattcacaagggctatatttccaatcttcaaatgttactttcttatttccaaagtcgaacataactccatccattcctgcaacttcgagttctttccatgttaaaggtaattcataagtgttggtctctttatcttcattttcaaactgctgttcggtctgttgttcattttctacgttggtttgttgctcttcattaatttggttttcttcttcttcatttacattttcacaattttcaagttttttcaatccaatccaatcagracttacaagagtgtatccatcatactcaccaaactcatctttgtcaatagtaagtgtggttgttactctatttccatccacttcaatattataatctgtatatccatagttttcataatcattttctataatatattttctttttttagcatattcatcatcaatacatatccaaagtcccttaattacaattttatctccctcatcataataaaattcccctccatctgcatcaaactgattgtataatttgaatgcaaaatatccttttggcatttcatttattatctctcttatattttcatcttcagttaccaaattattttttccatttatagcatcaataactttttcaactcctccttttaatccaaatatgaaatatcctttatagtttgtagctgcaaatttgcctaccatatcagatacttctgtagtatatactaacaaagtagctccaccataatattcctcattgtaactatagcccaatttttttaagtattctttagcagttagtttatctgtttttattaaattggctgtttctaagttcatataaaactcaacatcatctggagataatccatagcactttaatatactgtttaactcatcatacacgccctttcccttcaccactttagaaaactttcctacatccacatagctcgcccaaaacacatttgggattaaattatatggctcttcaagattgatatttttattaactttgttggtattatcgtggttaaattcacttttctctttagtttgtgtattgtattcattttcagtattgtattttatttcatttccaaaatttaaaccaagtttgttagcataatctcctaagaattcctctttactcattattacctttgctacaactatattgccatccctatctatatcgtaatctttgatgtttccattatctaattcatcctctaattcctcttttacatattcatactgctcttttgcatcatctacgtcattatatacggcaacaacatcaaactctacatttcttcccttaaggtatataaaagcgccataataccccttataatttcttccgatatttgctattacataatcgtcatctactttacttaacatgtccttaatttccttcttctctgttatcgatggatagtccccttttattgtgtctataactctttttacatcttcagtatttccatgaataaggtaatttttgtattttgcaacagcataattgtgattttcatttataagcatatttgctccattatatttttcttctttataatctaagccaagttcgtccatgaatttatattcatctaagccatatccctttaatacataagtattgtctgcttggattgtgtattcaatatcatccacacttaaaccatacttcccaattaactccttatatgcatttactatttcactattctctcccaataaatcaacaaatccttctgttttagtatatacaactttttcagatgattttggaacaatatctaatggtgatgatatagatttttcagatatttttgactcttcataacttccttcctctgaaacacaaccagcaaataggacagcaatcgaaatagtcaaaataataacaaattttttcataaaaaacacctcctctttaatagtcgtcgtctcctccattatcaaagtcatcaacaacatcttcaacaaagtcctctgcctcttccacaatatcatcaattatatcttctccctcttttacaatatcttcaacctcttctttaatctcttcaccatattctgctactccataaccagttactgctccagctccaaaggcaatggctttatctattaaactatcatctttatcaccctctttttttcctctttcatcataaatgtcgtcatcgccataatcatggacatagacatctttagttacataatggtgatgataaacatcatgacttccataacctcttttacttgatgagcttccatgtctaacttgatatggttttggcttcttttttggaaatagaagtttttttatcagccaaattccaaaaattaaaattaaaagcccaattatggcaaaaattatgagtagagttaatattaaattcatattttcacctatatatttaaatatacaaatttttatatttaaaactaatataaaattttaaatttttaagcaatatacctgaatacagtagaaatttttatatagttgaatggatacctaataaatactttaaaattatttctataaatagtttaaagtattaaaaattttattatggcaattggtgattttaatggataagaggtttatagaattaataaaaaaaggttggaaattaaaaaatgaagaaaataaagcaacatatattgatgaagtttttttaggggcaataataacaacattaactgacaatggatatgttttaatggacatcgcttcaaatggaaacttccattactttatgtttgaacatttagaaagctgggatagaataaaaatagttgctgaagtgcttccccactcattaacagatgtcaaagttataggggcgaggatgtttattgaattttcttatggggttatgattaaaggaatcccaccatccttatttggtttaggattaaaaggatacctatctcaaatgctatcaaacattggaagtattagatatgagtatgatggttattatacttttgtaaattgtgcaacttatttgctaataaacgattacattgactttgacacgctaacgattgattgggaaaaactaaataatgatataaatgcaataatatcctctcttgctaaatatttagaaattcataaaaaggtggaataaatgggaatttttgatttagctaaaaaaataactcattcaagagaatacactaagagcattgacgagatattcgttggtgagttaataaattttatgtataaaaatggagctgttttaacagaaattaactcaccaacagaaagctctcacagcttaaccttcaaatttgtaaatcatccggtcttacacatacttaggattacggtagatagaaaaattgaggggatggcgtcaaaaattcttggttctcagtcagttttaacatttgaagcagtaattaaaaatgacttggttgaaccaaatgatgttttagttatgtatcaaactgattttaaaaatatgtttaaaattccaatatttggaaaagttaaaataaatcatgatttgaactacataatagcaacaacaacatatattgaagatttaggaaaatatataaaatcagatagaatagaaaaagaagcccttagggaagaattggagaagatattaaatacattagttaaacatttagagccattaaaaaagaagtttgactaatgttatttctattttcttatatttagattttcatattaaacaatacagaaaacaaaacttatttattcacttactttttattttagttataatctacattaatcatattcaaaaggtgaaataatgagaagtataataaagggaagagtttggaagtttggaaataacgtagatacagatgctatattaccagcaaggtatttagtttatacaaaaccagaggaattagctcagtttgttatgactggggcagacccagattttccaaagaaggttaagccaggagatataatagttggaggaaagaactttggatgtggttcaagtagagagcatgccccattaggattaaaaggagctggaatcagctgtgttattgctgagagcttcgcaagaatattttatagaaatgccataaatgttggattaccattaattgaatgtaagggcatttcagagaaagtcaatgaaggggatgagttagaggttaatttagagactggagagattaaaaacttaaccactggagaggttttaaaaggtcaaaaattaccagaattcatgatggaaattttagaggctggaggattaatgccatacttaaagaaaaagatggctgaaagccaataattttattttttggtggtaattatggctacacagacgataactttaacttttgaaattccagaatttattgataaaaataaattcaaaaaggagcttgaaaatttcatcaagaaaaaaatcttgggagagaaattctataaacttatggaaaaggtgtagatgttgaaaaaattgaaaaagaatgtgaagaatttagaaaaaaattcaaattcagaaattgaattttatgaagagggagaagatgataagtgatagagtaaaaaaaggattaaaaagagctccaaatagaagtttattaaaggcttgtggatatacagatgaggaattggagagaccatttattggagttgttaatagctttaccgaagttgttcctgggcatattcatttaagagatattgctgaggcagttaaaaaaggaatttacgcaaatggaggaactgcctttgaattcaacacaatggcaatatgtgatggaatagcaatgggacatgaggggatgaaatattccttaccttcaagggaaattatagcagatactgtagagagtatggcaaaagctcatggatttgatggattagttttaattccttcatgcgacaaaatagttcctggaatgataatgggagctataagaactggattaccatttatagttgttactggggggccgatgtttcctggagagttgagagggaaaaagtatgatttaattagtgtatttgagggagttggagcttgtgcagctggaaaaattacagaggaagaacttaaagagattgaagatattgcctgcccaggagctggtagttgtgctggactatttacagcaaataccatggcttgcttaacagaggctatgggcctctctttgccatattgtgcaacatcacatgcaacaacagcagagaagataagaatagctaaaagaagtgggatgagaatagttgatttagttagaaacaacataactccagataagattttaactaaggaggcatttgaaaatgccattttggtagatttagctttgggtggttcaacaaatacaactctacatattccggcaatagcaaatgaggtaaagccaaagttcataacattggatgactttgatagattatctggtgaagttcctcacatagcttctttaagacctggtggagagcactttataattgacttgcacagagctggaggaattccagctgttttaaaggttttagaggaaaaaataagaaaagaatgcttaacagttagtggaaaaaccattggagaaataattaaagaggttaaatacattgattatagtgtaataagacctgtagataatccagttcatgaaacagctggtttgagaatattgaaaggaagcttagctcctaacggagcagttgttaaaatcggagctgtaaatccaaaaatgtataagcatgaagggcctgcaagagtctttgatagtgaggaagaggcagttgatgctatattggggggagatattgagagaggagatgttgtggttatcagatatgaggggcctgcaggagggccaggaatgagggaaatgttggctccaacttcagcaatatgtggaatggggttggatgattctgtcgctttaattacagatggaagattcagcggaggaagtagaggaccgtgtattgggcacgtttctccagaggcaatggctggaggtccgatagcgatagttgaagatggagatattataaaaatagacatgataaacaagaagttggatttagctttagatgaagaagagattaaagagagattagccaaatggaaaaaacctgaacctaaggttaaaaaaggttatttagcaagatatgctaagcttgtaagttcagctgatgagggagctgtattaagatatgattaatagagatttctttatgcttattgtattttttacataatatttttattaccaatttataattttgtcgtaatacactaggactaggatttttaattttatatggatttggaaagtttatctcgttcaatacatttataattaggaaaaacccatttaaaatctgatatcattatttttaaccttttttatctaatttctaagggtagcttattttaaaaattttatttatttggatttgttaaattatagggatttttaaaaaattctacttaattgtttttattttgagatttctccaatgattaatttttattttgaaaatcaaatattttaaaaaccaagtttataccatagagaaaagtttaaatattggttaatggtatataaataaaaggtgaaacctacccatcggtaaaatgtgggtagtaaaatataaatatcagaaagattataaaataaatcatctgatatgaccgcctgttaaaatcagacctcttggaggatggaaaccaattgtctaactgcttcccctaatccttcctttatatcctccgttaaaatcagacctcttggaggatggaaacgttaattgcattctgatagttcataaatgacaccattgttaaaatcagacctcttggaggatggaaacttaataaattattattattattgtaatatattagttctcctcgttaaaatcagacctcttggaggatggaaattatagctaaaaatatcaatataattgggaataaattaatctcctggttaaaatcagacctcttggaggatggaaacctttatgaactctaaatcactctcattgagatttcctgtagttaaaatcaggaatggatgatattaagatttaaaaaaattaatttttagcttttttattacattttgcaacaaatatatgcttcaccactattggagttattgtagctgttattacagagagagctacaattgttacaaatatttcatttcctattaaaccaagttctcttccaattgatgctgctactaacgaagctgaaatttttggaactgttaataaacctccaatagtattttttattctatcaaaacctaaaattcttaaagcgataaaaccagagataaattttaacgccactgctgaaattagtgtgattaataaaagctctaagttacttaaattaaatataactcttatatttgtctccattcctaaaactaagaagaatattggtataaagaaaccataaccaattgcattcaaatttttgtttagaagttcatcatgctcttctttagttaaagcttcactaacagcaacaccacagataaaagccccaactattggatgaattccaataacctccccaactattatggcaatgaatataataaataaaacatagtgtattctttgagcgtgaagcttttcaaatactccaaggatatttttggatagtgatgggatagctaaaagtaacacaccaatgtataaaactgtctctaataagaatgttcccacattctctccaccaatccctaactttataactactgataataaaagaagagtaaataaatcaacgataattgtagcacttaaaattatagtccccaatcttgttttaaccattttcagctcttctaatattgcataaacaattgctacagaatgagacgcaaatattacagcatataacaaactcccaataaatccaagacctaaatactgcccaattaggtaacctccaacaccagggattagtagtgagaataaacttaaaattagggagttcttaaactcttgttttaaagtttcattatctacttcaagtcctgctaaaaacattaacataatcgctccaaaatctgcaagtatttttaatgtctcatccacctgcaatatatttaacccataaggacctataataatccctgcaatcataatggatgttatggcagggatgttaaacttctttaatagattaggcacaatgaagattattgataatattatgaagaacacataataataactttccattaccccaccatcaaaattttaattgtttaggttagagggctattttaatatataacccttttgctggaaccattcttagtcattctaaaagttttgaaagacatgaaaaattggtgatataaatgctaatcttagcgggtttaggattgtatgatgaaaatgacatgaccttaaaaaccttaaaatttgccaaaaaagctgagaaaatctatgctgaattctacactgcagttttaactggaactacaactgaaaaaatagaagaggttttaggtaaaaagattcatgttttaagtaggaaagatgttgaatacaatggatataagttgatagaagaggcaaaggataaagacataatgtttttaactgctggcgacccaatggttgctacaacacacgttgatttagcaatagaggcaaaaaagaaagggattgaagttttaataataaatgctccatccatatattcagctgttggaattactggattgcagttgtataaatttggtaaaactacatcaattgtctttccagaagaaaactactttccagaaactccatacaatgtaataaaggaaaacttagagagagggttgcatactctctgcttattggatattaggattgatgaaaatgaaaagaggtttatgacagcaaatgaaggattaaaagtgttgttagaattagaaaatagaaagaaagaaggaattataaatgaagatacaaaggctgtggtggttgcaagagctggaagtttaaaaccaaaacttgtctatgggaagataaaagatttaattaattatgattttggtgagcctttgcattgcataataattccaggaaaacttcattttatggaagaagatgcattaaaatatttatgtgaaaatatttaaaaattttaaaaattttttatgttgttgaactttcagcatcgttgtataactcatctccaacatcaacttcttcttcaaatcctctgctatccttcaatgtctctattctgaacatataggatttataccaaatatcttctggttttttctttacaggagctaatttccaagctcttgtttcttcttcataaccccaatttacatagtggttgaaattccttattatgtcagttataaccacattgaagtcgtttatcaatgttctttgaatttctctccacttatccaatgaactctctcttcttgtaattccaaagtaaccagctcttctctctccttttaatgctgatattcctctaccaatgaatgtttttacagcataaactgtttctggtgggtctgttataaaagtatcaaacgctctgctgtatttctctggaagtggttttcttaaatctaaggttataacttctatatttttgtaatttaattgctcagcaacctcttttatgaagttgattaatctatcgtcaatatcaacaacaactattttttttggaagatttgagagcattaaagcaatacttgttaagtcatcatcccctaaaactaaaacatccttattgaataaatctcctcttgagttcattaaagcgattcttgaaattgtgcattctggtgtaacgaaaccttggtcgtattcgtgttttggcattggtctatttttaacaatctctttaaatctctctaataaatcttggtagttctttaaagaaacccccctcccttcacagcattcacaaacactattatctttagctccaattccataggattttataaattcatttcctttttcagtaaattctattccattacttatctttactaatccctcctcttctaaaattcttataatatcagcaactaaaggtaatggttcctcacttaaatcaacaatcttccaaaaatcgttggttgttaaaatagctgacaaaacattctcaattgatttgtcatatactggaatctctgactttgctctaaccttctctaagattctttccattatttcacctctaagtattttctatagcaagctccctgtcctattccctcattgatagagacctctatccaatttatattagaaaaaccgagattttttaatctatctgctatttcattggcaaaatatattgctaaatcttcagctgtagttgatggaataggtaataaaatgacatcctcaacaggaatactgtattctttattctcatatttaaagtatagggttttatctcttaactcataatatacatgttcatgattttttggaagtattaatttgtggtctaattcatcacaaatctcttttacaatttttttaattattttaaaatcacatacaaatttgaagtctccagccctctctccataaagttttacatctacataataagaatgtccatgtataaccccacaagttggatgtccaaatacaatatgggctgatgaaaaccttaaacctgcatgtagtccatttaactccaacatcatgtttttacacctttttttgattgtattagttttctcttttttaaataattgactaagccaccagcagccaatatttctctttctaaaccttttggtgtttcacactttattgttttgtttttattggttattacaatctcttctttatctaaatcaatctctactatgtctccgtctttaatttcatctgtatttgctattattggtattaatccaacgtttattgcatttctatagaatattcttgcaaagctttttgctatcacagccttaataccacagtattttattgctattacagcctgctccctacttgaaccacaaccaaaattctctccagcaactatcacatccccctccttaacctttttcgggaagttttcatctatccctgccatgcagtgtgaagctaactcgtaagggtctgtagtccttaagtaaggtcctggaattattgcgtctgtatctacatcatccccaaatttgtgagctcttcccttaataatcatttcttatcaccacaaaaatattttatcttaattttaaaaattaaatttcaaaagagctgaaaatgttcaaataaaaatattctttaggaaatatggtatctttcagaaattaataaaatttattaatgggtattataggagtttctatatatttacttcagaatgataaaaacatttattctcgggagaattctattatatttagttatttgccactaatttccatgattttctttttcattggtggagttataattggtttctctggaattaagccagatggcttgtagtagaggataagaagcattaaaactccaaataacatatatgaaagccagacgggctcaaatggaatacctaatgcatattttatattatatttgtatatatctaataagaccttaactatcacataacataaaacccctaaagcaactcctttgttatttccctttcctcccaataataccattaaaaatgggaagaaagtccaatctactcttgtaaatgcattagcaatgatatttacagtatataatgaatacaaaacccctgcaattgctccaattgcagaaccaattgccattgtttttattcttaatttcattatatctctaccaaatgctttaactgtattttcattttctctcatagcccttaatactctaccaaatggagtattcaacaatctttcaaagaataaataaactaagaaagcaataaataatacaatccatgcaaatacccaacctctatattctccagagacaaatgctaatatatctggggttgaaattccataataaccaccaattatatttaagttatatgtgcagattaaaagaactgcttcacttatagctaataaggtaattcctaaatagtcctcctttaatttagcacttggtaagataaagattgccccaactacaaaaccaagaattgaagccaatattattgctaatattaatattccaatcccaactattggatttgaggcaattaaattgtttatagcagatgttgcataagtagttccagtgataaaatctcctccaataccgaaatatagcattaacaacctatctaaaattcccccaactgcaatagctccaaccaaaactgataatgccttaccaaagtttggaattcctgcataaccaaattccatatttaaggaaagagaaacaatataataaagcccaaaccacaataaaatcatggatattaaatcaatactcatattttcaccccataagttaaattatgaagtagataataatctttttaactttttccaatcgactccagtaattccataaggtgctattaataatgttgctatcattattattaaggagataacctttccataaaccaaaaatcctgttccaaatgctgatgctaaataataagttattaaactctcagatattccaattatatagccccctattaatgctccacttatatgccttaaacctccaacaatacttgccgcaaagattgaaataataattaaatccccagtggctggaacaatctcttgcatgaaaggtaaaagcccaccagcaactccagctaaagctccagaaagaatccaagaaaataatcttgttttttcaacatcaattcccatagtttgagctaatgaaggattctccattgaagctctcaaagcaataccaaactttgttttatacaggaggagataaagtccaattaatagtagtataactacgaaggttgaaacaaataaaattcctttaaatccaaataatgaaaaatccaagtttgcaaaaacgaattttgcttgagtagaaccaacaatttgacttaatatttcagagtaagccccaataacacccaataatattaaatctatagcaagagttgcaatcattaaaatctctacagaggcatttctttttatcaagggctttaaagctaaataagttattaaaccaacaattgccccaacaacaaataaaactggtaaagaaagataaggacaaataccaaacaactttaataatgttaaagcaacataactcccaactatcgcataacttccctgagcaaagtttggaacgtttgttgttatataagttagagttaatcccaaagccaacaaaaccaaaaggttggagtatataatagctccttctaaaatcattttctcacctaaatcttttagtaaaagcttgaccaaatgtgttcattaggttttataaaaattataccttatacagcagttattcctaatgaatattccttaaatttctcatggtttaacaactcttctgctgttccctcaaatgctactcttccacttacaaacatatagccgttatcactaatctctaaagctctcttagcattttgctcaaccaacaaaattgttagtccaaagttatccctcatctcaataatcttttcaaatatcacttcagcgagttttggtgacaattgagcagttggttcatctaacattaagacctcagcatccctaactaaagccatacccatggctaagaactgcctctgtcctccactaagcgttcctgcctttctctttaaaatgtccttaagctctgggaatacacttaaggctatttcaattctttcctttaccttatctttatctaatacataaccagcaatttttaagttctcctctacggtcaaattagcaaatacattgtttgtttgtggtaaataagctattttcatccttgctttttgatgtggagggacttttgctatatctttatccttaaatataatctctccagaatatatttttgttaaaccaaacaacgtttttaaaaatgtggattttccactaccattaggtccaacaactgtggtaattttcccttttctatttttgcattcacatcaaatagtatctgcaattttccataaccagcgtttagattttttacttttatcatattaatcaccaaggattttatttattctccaatgtaaatttcaacaacttttgggtccgataagacattcttaatctcctcttctcccctaccttcagcaataatctgtccattaaacataacatacaagtggtctatatagttcaaaacaatatctaacctatgctcaataattaggaaagttattcctttagcttttaattcaaggacgtgattaaatatatcgtgagctaaacctggagcaactcctgctattggctcatccataacaatcatttttggatttgtcatcaaagctcttccaatctcaacaagtttcatctgccctccacttaactctcctgcctttctatcatatagatgggataattttaaaaattccaatattttgaatgccttttcaaccatttcttcctcttttggaatccattttttatagaatagggaatttaaagggctttctcccggattaatctctcctattaacaaattttctaagaccgtcatctcttttaatggctgaggtgtttgaaaagttctaacaattccgtaatggtagagttctgctggttctttgttggttatatccttattttcaaaataaactctcccctcatctgcctttaaaaatcctgtaataacatttattagggtagattttccacttccgtttggtcctatgattaacgtaacatctcccttatttacacttatagaaaccccgtctaaagctttaaactctccaaaatattttacaatattttctgtccttaaaatctccattgtatccctcaaaaaaatgataaaaagtttaaagaataaaatttataatcttagaacttgcatatcttaaaaatttaaaaaagagttatttaaagttttaggaattttttatttccagttgatttttccagttgttgaatcccaaactccaactaacttccatccatcttctgttactgcaaagattccatagtttccacttgctctgtcattccattcatttaatttaatgtatccagttactgacttaacaccgaactgcccttctgagtatttaacagtattttcttttattagttttgataataagtcagcgtcgtattttccaccagttttatttaacatttcagcatatgaaatagctccaacccagaatgcatcatagacgtttaatgcatactggtcaggctctccatatcctctctttttaaactcttcttttatcttttcagcttcatccgtctctgactggaacattgttgaatagagtttaaccttaactgccttgtttttagcctcttccaatacctttttactgtttgcagttccgtcacaaccaatccaaacatgttttaataatggtgagttatcatcaatctgtgataataatgttgcaacctcttcataaccaatgaatattactccagtatcatttccttttccagcaattttatttgttgtagtttggattattggactccagtccccaatgttagggtcgtaaggaatttcatcaataatatttattccatttgcctttagtttttcaacagttgctctctccaacccatctccccaagcatcctttctgtatatgactattacattttttaaaccaagttgcttagcaacatctccaatggcatttccttggaagttatctgttgggacaaatctaaatacatactttttctcttctggagttctaaatccaagcatctgtggtggggcagttgaacttggggatattataacgattttatttgagttaataaatcctttaatatttttgacttcaccacttgccattggtcctaagaaaaaggttattccctgagcgtgaagagcttgaaccttctgcaaacatatattagggtctgctcttgtatcttcaacataaagttttactttgtaaggcattcccttctcttcaaagtatttgtttatcttctcttctgcaatctcacaaatatgtttttcattgtttccataggttgctaaacctccagataaatcaaccaacaaaccaactttaatgacattttctttacttcctgactgagttgttgtagtttcctgattttgtgtgcatcctgctaaaaacacacctcctatgagaatagccccccaataatagggcaattattcttttaatggtatcacctcaaaatgttatggcaatttcattttttatatatgagcaatatttaaatttttcgagatagatttaaccaacaatattatcattatttttaataacttccgtatcaaaaagctttaaagtattagtaataataatagtaattatataatatcaaaagcgggatagttatgaaagaaagaacctttgtagctttaaaaccagatgctgtaaaaagaaaactaattggaaaaatcattgaaagatttgaaaataaaggttttgagattgtggctatgaagatgattaaattagatagagagatggcagaaaaatattatgaagagcataaagggaaagaattttatgagagactaataaactttatgacatctggaagaatgatagttatggttgttgagggagaaaatgccatatctgttgtaagaaagatgattggtaaaacaaatcctgctgaagcagaaccaggaactataagaggagattttgctttaacaaccccggataatataattcatgcatcagattcaaaggaaagtgctgaaagagagataaaactattttttaaagaggatgagatatttgataaataagcataaaggtttaataacacatccttcattttttgtatatccacaaataatattaattaactaataaggtgtaattatggatgagaatgatttaaagtatatagaaaaagttttaggaagaaagccaaaccacatagagttagcaatgtttgaaaacttatggagtgagcactgtgcttatagaacctcaaaaaagctcttaagaatgtttgctaaaacagttaatgaaaagacctctaaaaatatagttgttggaattggagatgatgccgctgtaattagattgaaaaatgatatctgcttagcaatagctatggaaagccataaccacccatcatacatagacccatataatggagctgctacaggagttggtgggattgttagagatgttttgtcaatgggagctaagccaatagctttattagacccattaaggtttggagatatatttggaaaggaaggggataaagttagatggctaattgaaggagttgttaaaggtattggagattatggaaataggattggagtcccaacagttggaggagagtgtgagtttgatagctcttttgattacaacaacttagtaaatgttgtttgtgtcggcttagttaaggagaatgaaatcattacaggtaaagctaaagagccaggattgtctttaatattaatcggctcaacaggaagggatggaataggaggagcttcatttgcatcaaaggatttaactgaggaaagtgaggaagaaaggccaagtgttcaggttggggatgcattttctgaaaaatgtttaattgatgctgttttagaggcagtaaaaacaggaaaagttaaagctatgaaggatttaggggctgcggggctttcaggagcttcatctgagatgtgttatggtggaggagtaggatgtgagctttacttagaaaatgttgtattgagagagccattaactccttacgaaattatggtttctgagagtcaggagaggatgttattagctgttgaaccaggaagtgaggaggaaataattgaaatatttaaaaagtatgaactacctgcatcagttattggaaaaacaattccagagaagaggattattgccaaatacaaaggagaagttgttgttgatttaccattagatttgttatgtgaagctcctttatatgatagggaaggtaaagaggacttaaaagaaaaagaggatgataaggaaaaaataaagatgccagaagatttaaatgctgtgttattaaaactcttagagagtccaaatatttgctcaaaggaatggatttatcagcagtatgaccacgaagttcaaataagaactgttgtaaagccaggaaaagatgccgctgttttaagaataaatgaagtttatccaatgggaattgccttaacaactgactgtaactcaagatactgcaaactaaacccttatgtaggggcagtaaatgctgtagctgaagctgtgagaaatttagcaacagttggagctgaaccaatagctatgcttgataatctaaactttggaaatcctgaaagaccagagagattttggcagttggcagaatgcattaaaggtttagcagatgccgctgaattctttgaaatcccagttgttggaggaaacgtaagtttatacaatgaaacagttattgaaggtaaagaacatccaataaacccaactcccgcaatatttgtattaggtaaagttgaggatgttgaaaaagttccgggagttttagataacaagattaaggaaggagatatattaataattacaaatgaaacaaaagatgaaatgggaggaagcgaatattataaagttatacacaatactgaagagggaagagtgccaagagttgatttagagaaagagaagaagatttatgaagaagttagggaagttgtaaaagaaggattggttagtgaggcagtagattgctcaagaggaggtttagctgtagctttagccaaaatggctgtattaaacaatattggtttagaagttgatttaactgagtataataaaaataatttaagggacgatattttactgttctcagaaacttctggaaggataatattggcagttagagatgaaaataaagataaagttttaagtaaattaagttctgcttatataattggaaaagttggaggaagcagattgaaaataaagattaacgaaaaggatgttgttaatttggatgtggaagagatgaaaaagaggtattatgaagcatttccaaagatgatgggagagctttagattaaatattcttatttttttagtttatctaactttactacctgcttttatatccttatcaacagttaataagctaacatttccttcatcatcttcggctgctaaaatcattccttcagataaaacaccacataatttagctggttttaaattgcaaataacaataaccttttttccaactaaatcttcaggtttataatatcctttaattcctgaaacaatctgtctcttctcatctcccaaatcaaccattagttttaaaagtttctttgattttggtatgtcttctgcctctacaacttctccaactcttaaatcaatcttttctaaataacttatatctatttgctccattttttctcctccttttgtttcttcttttttattttcataaagctttttcttcatctcttctatcttcttattatctatctttttgaatataatctttggtttctttaattcattccctctaagctctaaatcaagttcttcattcattaattccaatagtgcaagagattttttaggcatgtatgggtatagcagatagacaagagtttttactgtcttgcagcaagtatataatatttccttcaatctttcttcatcatcaacagcccaaggctccatcttttggaagtaactgtttccttcaatggcaagatgtaatatattaactaaagcatctctaaacttaaagctccttatgtttttatccacagcctcaagtgtctcttcacattttttcaatagctctttatcttcctcttttaatctatcttcatcaactattgggactttcttaaactttctatgggtaaaggttaaaactctgtgggtgaagtttccaattatgttgatgagttcattgtttatcttatttttgaaatcatcaaatgagaaatcacaatctttaaagagaggggctgacatgattaagtagtatcttaaatagtcagcatcaaagtttttaacaaaatctttaacccaaacaacccatcttttacttgtgctcatctttcttccttctaaggttagataacctccactaactactgcagttggtaagttaaaggaaccatgagcaatcaacattcctggccagaaaacggcatgatgaacagttatatcctttccaatgaagtgataaatctttgtatctttctctaaccaatatttcttccaaatctctcccaacatctttgtaaatgagatatagccaataggggcttctaaccaaacatacattacttgattagtccctggaattggaactccccagcttatatctcttgaaatatcccaatcatgtaactctttaatccaattcaatgccatatttttaacatgctctggcatttcttttgcattttttatatactcctctaactccttttttaaagcacttaacttaaagaagtgatgttttgtctttctaatctctggctttcctttgcaaattacacaatatgggtcttttaactcaaacggctctaagtgtcttccacaaacttcacagtggtctcctcttgcctctcctccacagtatgggcagattccctcaacatatctatctggtaagaattttttacagtttggacagtaaaattgctctatttccttctcatagatatagccattctcttttagctttagataaaactcttgagctgtttctatatgtatttggctgtgagttttgccaaatgcatcaaactctactcctaacaaatctaaatcttctttaatctcattatggtatttttcaacaatctcctctgggctttttccctctttttcagcagttaatgttataggaactccgtggttatcagttcctccaacgtggataacatcttcccctctcaactttaagtatttatatataatatctgctgggatgtaagtgcttcttgcatgccctaaatgtagagggccgtttgtataagctaaggcagttgttattagatatctcatcctctccctccttttgactaatagtgtctttcaaaatattttgtaataactattaatgtattaatgaacgccttcttatagaaggcattcaaatttccttaataaactttaataccttttttgaaagacactaaaatttcttttttttcttccctaagatgtgccttgctatagggtcatctatatttaatagtttagcaattgcttcaagttttttagtggttatctcaactgtttcatgggatttttttaatatataagggtagccattaattgatatttcttttaatgaggataagacttctttatctattttattgaagcttgttaatccaacaactccacagttatcttctaatctcacaaattgtatatatgcagtgtcaatttttgcatagaatggcttgtttttaataaagtttattccttttaccacactacttaattgtttatgcttttctttcttttcatcccctaatttattaacaaagtcaattggttctgaataaccagatttgtcggtatattttgtaaatatggctatatcaggcatgtttttatcgaaataaatgtttatttttgaagtttttgatattcctataattctatctttaaattcgttaataagttttgttaatgttaaaatatattcaacatgctcaactaatatttttttatttaattccaagttcaaatcttttgatataatgccaatttctccagattttgtttcttcatcaatttttttattaaattcttttccatattcattataaatctcttctaactctctctcatacatctctatacctttttttgtgaatatcaacaaagaaaataaagacccatcaaaaatgtaataatcaatattataatttttgagaacataaagggctgtttttaattccaaagttagcatatatctccttattctatcttcaatatccaaaggatgggttatatcaaatatatactcctccttagctttttttactttttcccctctgccgtgtataaagctaacggccccaactccatagaatgagaaagatatgtaatccaatttattacagcttccatctcctcctgcaaatcccatatcttttggattttcaaaattatccaaaatccatttttcttcaacttctttacgattgatatcattaattttttccatttttttaataatttgctctctgttttttaatagatattcaatcatcaataatccctcaattttagtaagaattaaaggattaggcaatataactgtattttctacaaaaattttaaaaaacattaaaataattctccctcaatcgttccaataagcatagaggaagcctccatcagatgaaatcctaaaggatttcattactcgcccctacggggcgattgcgatactccctaacacctcctcgctaacgctcggaggtgtaaatttgatactcatattattaaaattatccctcaattgttccataaccaattaatctccatcttgagccaactcttctgctaatagctactctatctccaatctcagcacatattggaagctttaattttatatccgctatatctcctcttgctgaggttataacccccgcggttgtagcagttccaatatttagcattaaaacctctcctgttcttaatggctctattttcaattcctccttagttcctacaaccctatccaacaaattagcccttattgttatcttctctcttataggagggagagttccaggcaatccaacaacacttccagttaatgcatctgattttgttaagtatgggtctaatgttgtcccaaccccaatcaaaccccctggatgagcttttctaagtatggtatttccagcggctaatgaaacaatctttgtagttaatggtttccagaatgttttgtttccttcagttactttgattccaggtcttatttcaatctcatccccaactttaaatactccctgaataattgcccctcctaaaacccctccttttaaatccttaatctcagttcctggtttgtttatgtcaaagcttcttgcaacatacattcttggtgttgcatcagggtctctcttaggtgttggaataaagtcctgtattgcctttaacaaaacatcaatatttgcttcgtggtgggctgagattgggattattggagcgttttcagcaatagttcccttaacaaattcttttatttgctcataattttcttctgcctgcttctcatcaactaaatcaattttattttggacaattataattttatcaattcctaaaatctctaaagccattaaatgctcttttgtttgtggttgtgggcatggttcattagcggctataaccaaaattgctccatccatcaaagaagctccagaaagcattgtagccattaatgtttcgtgccctggggaatcaacaaaagagacccttctcaaaaactctgtttcagctaaacagtttggacatcttggttttgttgtgtaagttccacattgtgggcattttcttatctcacagtcagcataacccaatctaattgaaatccctcttctcaactcttcactatgcctgtcagtccaaactcctgttaatgcttttgttaaacttgtttttccatggtcaacgtgtccaaccattccaatatttacttctgcctgtttagcttgttttttctttgccataattatcccctttataaatttcttatttatctgtaaaatataagtgtttttcaaatatataatttttgaaaaatgcatttataaaagccctacgggcttttatatttattccttaatttttattaactttgaaaaacacttatggtattttcacatttttataattttagcttataaagttatactcggagtatcaaaatagtcaaaaaactacagaaatcaccactacaatatttaaacacagataaataaaataaaaataaaattaggagctatattttatttattgttcttgattttctccaccttctaatcctaacaattcagggattgatttctctccatattcaacaaccttaacgttaatttggacaatatcaggagctattgtgtttcctctaactgtttttcttcttctttctccttttctttttggtttaaacccaggaggagcactcaataaaactctaacctttctacttccgtggatatctggtctcattgggaaaccgcttgagtcagttcctcctcttatttgtaatttgtagccctctaatcctataatttttccatcaaatacttccccaattttcttaccaactaatggtgtgttatctgcctcaatttgatagcatcttcctgtttttgggtctgcaacaacgaattttgctgttggcatagtattccctcctatttttatttttgttatttgtttggtttctaatttttaaattaacttttaagttttgataaaacagattttttaagggcatttttataaatatctttatttcaccctatgcctccccagcttcatcatttcactacccctttggggtaaaggggcagaactccactgggtcattgacacgtcccaactccattgggagtcaggacaatagccaggataattattgagacataatattttaaataatttttggttttaaactttcaatgctattgtgataatataatagagaattataagccctgcaatagctaaaaacatgtattgcgttcttaacatccttttccttctttgcatatactcaattctacacttctctgaacaaaaaacttggtctggaggtattgagataccacaatttaaacaatgtctgtgctttggaatctccatacttatccctcaattattgttccatttattattcctttactaacatttaagagctcttctggggttcctttaacaactgccacttttaatttagctctttcaataatcttagctgctaataaatcaacaactgatgaagaaccagcttttaatgaagatgatattgccaaatcaacaagttctttagcagacattttatcaaattttttggcatcttcatatttattagggtctttgtcatagactccatcaacatttgtccctataactaacaaatcagcatttataaactctgctaatgaagcagctacagcgtctgttgtatgtcctggatgggttcctcccatgacagggatttttcctaagtttaatataagttctgcctcttcaaatgatgtagggactttttttatactataatctcctaaagcagtaattaatatcattgcattcattcttgtagccattattccaagctcatcacaaaaactctcactggctccaagttctcttcctatttctatatattctcttgctgtttttccacctcctacgactatagctacctcatgcccctcatccttaatctttttaaaaatattggcatattccataattttttcagcttttgctccttcctttggcatcacgactgaacctcccaaatcaaaaacgattctcatcttctcaccaaccccatcctttaaaagagttattaatatcaaacaaaatagccctatttatagttttttgcaaaaggtataaattaaatatgaatatttgaacgccctatttgggacgttcattgtgtgccttatttatcttaataatgttttgcaaaaaactattttaattccatttagttctaaatattcaaatatttctattaatatgcacaaaaaataaaaaggtgtagtgatattatacatataatgtaagttgggcttaacctctcaatgctgcctttacatcttcgacctttacggtctttctctttgcgtgcttagctaaatcaactgatttccttgctatctctaaggcaatttcttccaaagcttcagcaaagtatttccctgccgcttcactaactctctgagcaccagccttctttaagattcttacacatggtgcaactggaagctcagccataataccacctcagaatcttacattttcaattttttattatgggagtatatatatttttcggagatattcctaaatatttttgctatacttttttgagtatcaatgtgagttcatttttagtattggctcttaaattaattattttgaatatttttatatttctataatagcttaggatttttaacactttctctaaatcctcttttttagttttcaaattccttgcttttaatgtatgaattatataaccattagtttttaaatgttttgcaaattttagtgttaagaagagggattcatcaggatatagattagtgtcattggttatcaaatcaatttcttcgttgatatctttttcaaaatctacgttctcagccctcttttttatatggattatattatttgcttttatttttaattctcctgtgtctatagcataaacctttttagccttttttgataacatcttcgcccatccaccaggagaggagccaatatctacaacgcagtttatgttttcaaatataaatggaaatttctccatcaactcctgcatttttctctctgagcgatttaatggtctttcaatatatctctttaggttttttaagttttttatgttttcttcaataacaagttcattaaattcatcctgaaatattgagatatagctctcatcctgcagaatctcaatatttattttaaaatcccaatcttttagattaactctaagatttaaatctttaaaattttctaatacatattctccaattattctttcaagttcttcacttgtaaattcgtgatttcctcttctgttgcatctaactacgaaagatttattttttaatttttctttctttttattgattaaaaaagagatggctttttttatctcattaatgtctgtttggcatcctatttccaatggaattatccttagtgaaaattttaaattatttttattttctttgataatatttaaaaattcataaggattttgagacaaaacttttaaaattcctctaaatggtgtccagagaattttcttttttattggtaatttatttagctcctctcttaattgtggctcaaatcctggttttgttgtaactaaagctaccggcttcataaagacccacagaactcaataatatttttagctaatctaactttatcatccaatgttttcataattgtgttggttattaaaacctcacaaggtatttctttagctatctctttatcaacattatctattactaaaacatcaactatgtctttatagaactcataaatccctttaacagagacatcataacctttagctttcattaatttacccgcaggacctgaaacagcagaatttccaactattggcgaaacaaccacaacctttttatcttttaatagctctttaattccatttaaacttaaaattggacctatggaagttattggatttgagggccctataataacaaggtcactattttttatggcctcaactgccttttcacaaggtttagcatatagagagttttcataaataacatctaaaacctcaacgtccccctttctcttaacccagaagtcatgaaactttaataaatcaacctttccatcaacttttgctaaaatttttgtctcaaccctatcatcagtcattgggattactttagctttaatccccaaagctactttctccatatctacaacttctgagagtttatgtcccctctttaaataataagttttatgcatttttaaggctctatctttatcccctatccttaaaacttcatcaaatccaagattttttaattgctcatgagtataaaaagtatcttccttaaccccataccatgtctcttcattaatcaaatctgctaaggtatatagaacggtatcaacatcaggagatagatataaatctcctatccaagtatcttcaccagtattaacaataacagccaactcttcattattaacaaccctttttaaaccctgcaataactttggtgtcccagttcctcctgacaatacagtaatcacaaatatcacctaatctttagcttgaatttattaattaacttattagctattctatcagttaagtagtattttcttatattttttcttgtttcaaaaaattcatctattatttttttaatatttttctttccatcatatttttttgcaagttctttcatttttgaagcgtttcttttatacatcttcatatttcttatgtctaaaattgcctcttctaatctatataactctttataagataaagctattccacaacccaaatcatggacttttttggcattatttccttgctctggatggtctaaatctggaatgacaattaatggttttccaaatgatagggcttccattattgttgaatgcccaccatgggatacaataagttcagcgttttttataagctctttcatatttgttgttattggaattatttctacattttcatttttataagagtttaagtttaaatctctcattagttttttagcaacttcataacttccacatacaagtttaacatttaggttattttttaaagcaatttttccaagttcttcaaggattttatatctatactcaaaaccaccaataacgcttaatatataatcttctccataattatcaacatcatcaacatcgtatctaattaacggcccaataaattccatattttttataatttttaggttgtattcacatatggtatagggtaaaggaaaatcaggaacaataaatctttcacatctctcatttataatgtttagagctttcattgttggataaactattaaatcagtttttaatttatatctcgtgtagttttgattacttatgcaaataactggcttttttaaaagctttgcagctacaactgtgctatatttacaatcagaaattatcaaatcaggattatattctcttataatattaatttctcttctaatggctttttttgggctgtattctttattcaatatacttgaggttatgtcaaattttccatcctttcctttaagttttatctctggaaaggtttcaaaaactttaaatccatatttttcaatgaaatttttgctttttccataggcaatgtaagagatttcgtaatcatttttcaatgcttcaccaattgcgacacatctcgttgtatgtccaaaaccctccccacatactgagattagaattttcatgttttcacccaaaatttttaaatgggttataataacttcttactctcttctgtaagggttaatttattgattcgtcctattttttctttccttattatttttctatcttctaattcggagataattctcgaaacctttggtttgctcattccagtaatttcaacaatttctttttgagtaatatgtccatgtttttttattaaatcgattataattttttcatcttcagttaaaaagctccataatactcctcttttttcttccatgtatttttttgcaatatcacttaactctctaaccttatcttttagcttatcattttctttctttaatgtttcgatatatttatttaatgattcaattttttctttatatattatattttcatctaaaagtttttgtatttgactttcatattctgaaatcctttcatttagaacactaataatctcatctttatttagcaagtttttattagccttacttaatttatcttccaaatcttttatttttattgctaagtttttgatttcttcttctttttcttttaatttattttttaaggaggttaattcattttttatatttttagttctttctataatcttccttttagaaattttttccttaacaaataatcctccaaatattgctgttccaaatattgcgattattaggagatatttcaaattattgttaatggctggctgttctatgatattttgtccaggatatgatatgaaagtgtatttcacagtaattgtgaaagttatttccttatttaaagacaaatcccatacaataatttgatgttttccgtcggtagttattttatagccagaaggcgttacaagtaaagttccttgaggggagagaataactgcccctggtgggagaactattttaatggttgcattttttgaggtaatggggaagctcagtataagttgcttaattccattttttgtccatattgcatcattaacaaaacaattaatagttatatttgtataacctcctttaggtattggtttttcaaattcaatagcgatttctgtaactccttcattgtataaagcactgtatccctttactcctgctgatgcatttattgtaaaatttcttatggtttgaggaattgtatatgatatatgagataggtttttgtcttcattgttatatataacaaaacttattgtttcgtttattgtatcgtctggagttacaatgcaatcaatatttagattcttaattacataagctgaagatacattaaaagccacaaaaaataataataaaaaaataataacatcttttgttttaatatatatcaccttcaaccataaagtatttgtatttatataactactgtttttatataaaaaatttatcttatagttctttgcaaaacatttatagaataaaaaggcaatcaatataatgaactccttcttagagggagtttaatcatccttagttaatttaaataactttgcaaagaacatactttggatggtatttgcagagcctctgcaaatatctctattaaaaaatacctttcaataatataatatatacattaattaatggggttggaaaaatgataaaagattataaagtgtctatagctattccaatagcccttcttatactttcaattttgttaattggttttaaagggattccaaaaagtatagatataactggagggacagaaataacaattaaagtaaatgaaaacatggatataactcctctaaaagagtcacttaatggaatagctgaagtaaaaaaattagaatcagctgatggatattacatagtcattagatgtaagaatgaagatgtagatattgtaaagcagaaaattaaggaatttttccacgtggatagcttagataagttaaattattctgaaaagacgattggggctactttaagctctaaattctttgaagaaggatttaaagctgttggatttgcatttatgtttatggctattgtagtttatctatatttcagaaatccagtgccaagtggtgctataatattatctgcactttcagatataattatggctttaggggctatgagcttattaggaattgagctttcctctgcaactatagcggctttattaatggttattggttacagtgtagattcagatatactgctaacaacaagagttctaaagagattaacaaagagctttgatgaaactgttaaagaggctatgaaaacaggtttaacaatgacattaacaacaatcactgctatgctaatattattaattgttgtaaagctcttcattccagtagcagatatactggcaaatatagcaactgtcttaattttggctttaattgctgacattataaacacttggctattgaatgctggaatattaaaatactacataactgaatatagagcaaagaagatttaattaaatatttaaaaatactctttttttaaaatctctaaaaacctttttattcccttctcaataccatttttttgcctctctttaatattttcaaaagttattaaattggcataaacatctgaagtaaataaatagcggttattatcggttaatatacaaatagctcccctcccaacaccagctgtggaaccaatggatatattaacattaagctttttctttaacccctctgccatcaacttagcaacttccaaatctttctcttcgctatatgcttttgcatatttataattaaaatctggctctggaagctttatatccaaaagtttttctactccaataatagaaggaacaaacatggcagatataactctaacatttttcattaattttaaatcctcctcactaaataaatacttaaattcaaaatcttcataaccagctgctgccttgtgaatagttaagccaatatttgcatgtgtaaagcattctgcagttgctacagttatcattaccatcaccgtgagaaaatgggaattaaagagtattatgacaagttggctaagagttatgataagctatataaaaacaagtatatgaggattgtggaaagggaaattatacagaaagagattaaagatggtgactttgtcttagatattggttgcggaactggagagcagttaaaaattttaaataatgcagttggtttagatatatcattagaaatggctaaaatagcaaaaaataaaacaaataagccagtagttgttgctaatgctgaatttctcccatttaaaaataagagttttgataaggcaatatctttctttggagctttaaatcattgtaatttaaagagagctttaagagaagttaatagggttttaaaggatgatggaatttttatattcactgtggcaaacatctacgatataaaatggattataaaaaacattttaaaaggaaattttaaaaaggtaaaaaatgccatgaaaaaaagaaaaggaacaataacaaaagtaattgatggagaaaaaataaaagtaaaaacaagattctatgattttaaggaggttgaagatgccttaaaaaaagaaggttttgaggtagtttatacatttgggacaaatattaccaattctccattagataaatttatttacaaaagctttttaaaaaactttgcatcatacattggatttgttgcgaaaaaggtaaaaaatagataaccgtttaaattcttttacttatttttcaatttctcttttccagcttttttaatagcatcatacatcatctcaacagctttaggattctcttccaacaaattaccagtaactatagcatcagctccagctaaaactttctcataggcaatctctggctttctaattcctccaccaacaattatattaattccagagagtttttttgataaggctatagtctcattgtttactgggtaagatgccccactaccagcctctaaataagcccatctcattccaaagaactttgcagataaacaatacattgcagttatttttggtttgttttgaggtatctctctaatctccccaacataaccaacggctgttttttttgctggttctatgcagagataagccattggaattggctctaaattatattttaaaattgttatcgcccctaaagttggggctgttacaacccaataagtgtttgctgagttcattaggctcatgtaaaacacagcgtcagcatatcttgacaatccatcaacatttccagggaatagaattattgggagcttagttatcttttttatttttttaactgtttcatctaaattaacaattccaatacttcctccaaccattattgcatctgcataatccttaacattttcagctatctcttcaatattttcttcttctgggtctaatagagttaaatagacagctccttcctcttcaataatttgatttaatcttttttcaactttgccaatctttatcttcataatctcacaggatttattttttatacataatttcctttggataatattttatcttaatctttaaatagccttcatcttcttttatatcgagttcctcccaattataaaatgcaactctatcaaatacaactcctttttcataaaactttattgttggatttcctaaaatgtagtcgtcaaataaaacaagtcctaaaattaaatttgataataaaaaacttatatatgggaagaaactatttgaatgaagtagggattttataaaaacgctaataatcataagaataaataaaaatcttaaagtttctataccgggtctttttatttcgtaaagtaattttcctttgtcagtgctttcaatctttatataacaatacgcccaagtaattccaaataaaataaaagaaagtaggaaggcaaatagaaaattataataaaataaagacaatattaaggaaaccagaattattaataaaaaagatattttaaacaatactgggtttattcctctcatatattatcacttttcaataatcgtctcttttattgccattccaaaatgccttgcatactcctctggttttattaaaactttgtctccaggttttaaatcaacaacagaaattggttctcctttttcattaaccaatcttatagtttcagcattctgcagtatagttctaataatatcccctttatactctgcctcaattaacactaaaggtcttctttcaatctttaccctgccaactattgcctcccttgtatttccatccttatctacaatcaaaaccttatctccagcttttagctcactgagatattttgttttattaccagggcataatatgtatgcatgaacaggtccagcattaactctgaatggccttgtagctacgtaagggttctcaacagtctcagaatgaactaagaagagagctcttgagtaggagccaattaacattccttctcctatcttcattagtgagcaggtatctatacaaaccctgtctccactacctattggctcaacctttgttactgttgctacatctaaagccactttctctttattcatctcttcaattaattttgataactcctttatatcctctaagttttttggatttaagagaaccccatcagtccctttctctaaaatttcataggcaacctttgcctcatcaactgaattaacacttgctacaatcttaacatccctatggaataaatcagctattaaattttctaatggaatgattgtccaatctctcccctctaagataatgttatcaacaaatccaaaccttgcaacctctgaagcaaactcttcatcttcctttgattcaattggaatgtatatggctgtttcttttcctaagttctttgcctcttttaaaaactctatgttgtcatttttatttactaaaacaatatccgcgtctaaggaatgggaggcaactttaatatttccaagttctttaattttttcaatatcttctggttcagcaacaactactgggattgatgactctaatgctgttgttactatcttctttttctcttcccagttatctccaataacattaacccatccaaatttcatagtttcaccctaagttattgttttagattttattgcctacccctatatttaacttctcaatttaataattttcctatttttacacgttgttctaatataattatattctaaaaataggaagatttatatactattagtgaataatttatcatagtttatgatatacagcataagttggagggatgaagatggaagttatagaaaagttatctgaactttctggaattgataaaaagtcattgaggagaatattaattatattagagttctccctaagaaaaaaggatggttctccaacaagttttgctgagaagtttaatataaaatcatttggtgatttatacaactacataagagatgtaaaaagtaatttaaaaagagaccatgaaattgagggattcaatggattgactgaaatgtggaaaagtgtagctccaagagcacaatattggattatggacacatttggagaggagaatccaagagatgctctattttctgcaagtgtatttacaatgaggacatttggaataatgttggataacttactattgctaaaaaagataattaaaacattagatgagtatcaaaaagaagttacagaatatgtttcagctcagaaatttgaggctgaggatttagaataaacgctttattttttattttatatatttttatattaaagtaaattacaatgtctctttattatttcactttcatctaaattcaatcttttcataatctcagctatgactaaatctaaaaatatcaaagctgtttcttcaaaagtggttcccattggtaaatattttgatttcttcacttctaaaggaattgttaaatcagcaaactctactacatttccacattcacatacaattgcgataatgttgttatttatattctttgcctttttagctactgttaaaacactctctgttcttccactacccgatattaaaattagtaaatcatctttttcataggaaggagttgtagtttccccaacaaaatatgatttaaaaccaagatgcattaatctcatggcaaaacatcttccaatatatccactcctacctactccaaaaataaaaatttttttagcttttataatcctatcaattaaagaatccagtttatttttccactcatcgtttgtatagaatttttttaatatcaatatattgttagatactatatcaagttcttccaatttcgacacctatcgaagttattttcacaaatgtatccaaatctatgaattaattattaaaaaataaatcagaaagatttaagttatttaaaaaatggtgggggtgctgggatttgaacccaggtccagggatttctcctgccgtggtccagcgccctataggcaactggagtccccgatgatagacctggctacaccacacccccgcatcaatgtagaatcttcacaggaataaatctactattggaatgacgataccctttaggcatcaaagtgccttataaatatataaattgtgaaagttctacaacgacacatataaaaagtaaaaggggatatataaattttacggtttaatacatggtgttgagggataaaatgatattattggatgagaacacaaaggcgatagttcagggaattactggaaggcagggaagttttcacacaaagaaaatgttagaatgtggaactaaaattgttggaggagtcacaccaggaaaaggagggcagaacgtccatggagttcctgtttttgatacagttaaagaggcagttaaagagacagatgccaatgcgtcagtaatttttgttccagctccatttgctaaagatgcagtttttgaggcaatagatgccggaattgagttgatagttgttattacagagcatatcccagttcatgatactatggagttcgtaaattacgctgaagatgttggagtgaagattatagggccgaatacaccaggtatagcatcaccaaaagttggcaagcttggaattataccaatggaagttttaaaagagggaagtgtagggatggtttcaagaagtggaactttaacttatgagatagctcaccaaataaaaaaggctggttttggagtttcaacttgcgtagggattggaggagacccaatagttggattaagatataaggaggttttagatttatttgagaaggatgatgagacagaagctattgttatgattggagagattggtggaggggctgaagaagaggcagctaaatttatagagaagatgaaaaaaccagttattggttatatagctggacaatcagcaccagaaggaaagagaatgggacatgctggagctattgttgagaaaggaaaaggaacagcagaaagtaagatgaaggctttagaagaggcaggtgcttatgtggcaaaaaatatatctgatattccaaagttattggcagggattttaggaaaataatatcctattatttaaaaatttgaaaattataatacgataattgttaaaatttctttttttaataacatattaaggaaactaaatgaaaaactttatattctatatttttaacagttaaattgtaacttttccacataagggggatattatgacaaaaagagttttgtttgaattgtttgttgaagaaaaaaatgtgggtaaagcaataaatataatgaccttagctggaattactggatttttcttgcataaatataggggattgtccccagataagtttaaaaatttaagtaaagaggagttagaggatattgagaaagtttatgaaattataagggatgagtctgataaagcagttgttattgggactgtagttaaagaggaaaaagctaaaaaaatagaagaactattaaaagaaaaaatgaacaatgagagatggacagtgatgaagattccaatattaaaggttaaggtccatagggtctaaaggtgggataaatgaaaatcttgttgtatttattcgttgaaagtgaaaatgttggaaaggcaataaacgctctatcagaaggaggaataactggatttttcttatatgattataaaggtatgtctccccaagattggcagggatttttgttagatgaagacccagagatggctattaaggcagttagtgatttagcacagaatgctgtattaattggaactattgttagtgaaaataaactcatggaaattgaaaagctaatagatgaaaaacttgctgactgcaaatacacgataattgaaattcctattgaaggaataattgtaaatatgccttaaaaatgaactttcacatgtggtgtttctttaatatgctaaaattcctcaaataaaaaacgcaaaaaacttctatttaaaatgaggagattatatgagtagaagaggaagaccaaaaattccaagatttatatctgaagaaccaaaatttaggatatttaaaccacatggagtttctcttacagaggtagataaagttatattgagtgtggatgagttagaggcaattaggttagttgattatcttgattacacacaagaagaggcatctaagttgatgggaatctcaagaagagttttgtggagcttattgacagaaggtagaaaaaagattgccgatgctttaataaatggaaaggcaatagttattgaaggaggagaatataagattagagaatgtggtttttgtatgaggcatagatttggcataaaaaagcactgtagaacttggagggaggagctatgatgctattggaagttaaaaatgtcacaaaaaaatttggagataaggtagttttaaaaaacatttcatttacattagaagaaggagagtcattagggattttgggaaagagtggagctggaaaatctgttctattgcacatgttaaggggaatggatggttatgagccaactgaagggcagattatttatcatgtctcctactgtgaaaaatgtggctatgtggatgtcccttcaaaagctggaactccttgtaaaaaatgtggaaatgagcttaaaaaaatagaagtggatttttggaatgacaaaaaatacacctataatttaaaaagaaaaattgctataatgcttcagagaacttttgctttatatggggagaaaactgttcttgaaaatatcttagaagctttacatcaggcaggttatgaagggaaggaagctattgatatggcattaaagttaatcaaaatggttaagttggagcatagaataacccacattgcaagagatttaagtggaggagagaagcagagggtagttttagcaaggcaaatagctaaagagccatttatattcttagctgatgaaccaactgggaccttagaccctcaaactgctaaattggttcattcagctttaaaagaacttgttattaagaataagataagcttaatcttaacctctcactggccagaggttattgctgagctaacagagaaggcaatttggttagataagggagaaatcataatggaaggaacttcagaggaagttgttaataaattcatggaaacagttaaagagtttaaaaaaccagaaacagaagttgaaattaaagaggacattataaagttagaaaatgtttcaaaacactactgttctgttgagagaggagttattaaagcagttgataatgtaactttaaacattagggagagagaaatatttggtttagttggaacaagtggagctggaaaaacaacattagcaaagattattgctggagttcttccaccttcaaaaggaaaatactggtttagagttggagatgaatgggttgatatgactaaacctggacctatgggtagaggaagggctaagaggtatattggtatattattccaagaatatgccctctatccacatagaactatcttagagaatttaacagaggctattggtttagaacttccagatgaatttgcaagaatgaaggcggtttatacgttggtttcagtaggatttagtgaagaagaggcagaggagattttagacaaatatcctcatgaattgagtgttggggagaggcatagatgtgctttagcacaagttttaataaaagagccaagagttgttatattagatgagcctactgggacaatggacccaataacaagaaacacagttgctgaatcaatccacaaatcaaggatagagttggagcaaacatatattattgtttcacacgatatggactttgtattgaatgtatgtgatagagctggattgatgagaaatggtaagttaataaaagttggtaagccagaagagatagttgctttattaacagaggaagagaagcaagagatgtttggacagaagtaatttttttatcctatttttatcttatttactgtttcaaagcttttttggttaaaatgtaaaaatttcttttttgtataaggttttattgcagtataagaaaaatattatatataaattaatgttcaaaatcttaaatatgtagtcatactactttttaattaaaatggtgttaaaaatggagataaagtggtatgttaaaagaggttttgaagataatttaatagatgccttaaatacttatggctcagcttgcgtcttgggcttagctggaatgggtaaaactaccattgcaagatatatctacacaaagttgaggagagagggagttaaggttgtttatcttacatctgatgaagaatcaaagaccattaaattttgagaagatgtataatagctttttaaatggaaataaaaaaatcctataaagattataaaaaacttgtttggaatgtaagtactgaatttacacaagccttagcaagaattatgttcttctatattgtcaatgatttagaaactgcaaagaatttagcaaaaattacaagtccgtatcttccaaaagttccaagtaagcttctaaaagagttaagtgaagcaatagaggaagagattaaagctaaatcagatattgaaaaagaaaaagccaaagaaaaagttaaaaaagcgtttgtaaagttgttttattatacagtgtaaaattatacactaaaacatctaacaaaatttaatatctcctctttatttggaattattggataaccaacaactatatcattatttttaatcctctctatgctttcctcatcattcaaagacaatataaaatctctccaattacctctatagtttttccttctatttagataacctttcatagattctaacgcattctcattaatctttgtagcataagggacatatatagctctctttgagtttatactgcattcttgcccatacagataataagctataaggttatgttcctctacaatatctttaaccaaactctcaactccctcaattccaacccaaatatctctgctacatctcatagcctctttgataacatccaaaatcctataatttttaaattttctttctttttcagttaaatactgcttgtttcctaaaacaacacataaatcaaagccataagatgcataaagctctaacaattcaaaagcatcaactctcttagcttgaactgtcataacaacttttgatatcttttccaacctctctaaaatctcttcatcttttataacctcattttcagcatctataatataataatcaaaatatcttccaataaagtgtccaaaatctacaatatcttcatttattttacttggttttatggctattcctatcattgccccaccatgaaaaactttaaataaccaactgtcattttaaataaaaattaatatttattaatttgctataaaataaaaggtgatatcttggaattttcagaatggtattcagatatattagaaaaagctgaaatttatgatgttaggtatccaataaaaggttgtggagtttatttaccttacggatttaaaataagaagatacacattcgaaataataagaaatttattagatgagagtgggcatgatgaggcattattcccaatgctgattccagaggatttattagctaaggaggcagagcatataaaaggatttgaggatgaggtttattgggtaactcatggaggaaaaacacagttagatgttaaattagctttaagacctacttcagaaacaccaatatactatatgatgaaactttgggttaaggttcatactgatttgccaataaaaatctatcagatagttaatacatttaggtatgaaacaaagcacacaagacctttaattaggttaagagagataatgacatttaaagaggcccacactgcccattcaacaaaggaagaggctgaaaaccaagtaaaagaagctatatctatctacaaaaaattctttgatactttgggtattccttatttaatatccaaaagaccagaatgggacaaattccctggggcagaatacacaatggcttttgacactatattcccagatggaagaactatgcagatagctacagtccataacttagggcagaacttctcaaagacatttgaaattatatttgaaacaccaactggagataaagattatgcttatcaaacatgctacggaatctcagatagggttatagcttcaattatagcaatacatggggatgagaaaggtttaattctgcctccaatagttgcaccaatacaggtagttatagttccattaattttcaaaggaaaggaagatattgttatggagaaggcaaaagagatttatgagaaattaaaaggtaaatttagagtccatatagatgatagggacataagacctggaaggaagtttaacgattgggagataaaaggcgttccattgaggattgaagtaggtccaaaagatattgagaataaaaagataaccttatttagaagagatacaatggagaaattccaggtggatgaaacccagttaatggaggttgtagaaaaaactttaaataatattatggaaaacattaagaatagagcatgggaaaaattcgaaaactttataaccatccttgaagatataaatcctgatgaaattaaaaatatactatctgaaaagaggggggtaattttagtcccatttaaggaagagatatacaacgaagaacttgaagagaaagtagaggcaactattttaggggagacagaatataaaggtaataaatatatagcaatagctaaaacctactaaatcttttcttatttttaggttaagatttatgaacaaaataaaatttttatttattgaaatattattagaaagctattaaaagtgagaaataggaaataggtaattatttaaggtgaaagaatggatgtaatgaaaggaacaacaaccgttggtttaatttgtgacgatgcagtaattttagcgacagataaaagggcatcattaggtaatttagtagctgacaaagaagcaaaaaaattatataagatagatgattacatagcgatgaccattgcgggaagtgttggagacgctcaagcgatagttaggttattaattgctgaggcaaaactatacaaaatgagaactgggagaaatatccctccattggcatgtgctaccctattgagtaatatattgcattcaagtagaatgttcccttttttaactcagataattattggtgggtatgatttattggaaggagctaaattattttcattagacccattaggaggaatgaacgaagaaaaaacttttacagctactggttctggttctccaattgcctatggggttttagaagctggatatgatagagatatgtcagttgaagaagggataaaattagccctaaatgcattaaaatcagcaatggaaagagacacattttcaggaaatggtatatcattagctgttataacaaaagatggtgttaagatatttgaggatgaagagattgaaaaaatcttagatagtatgaaagctaaacctaagaaaaaaaccacaaaaagaagtagaagaaagagcaaataaaataaattagatatggaattgttagaattaagctaaaggctaataagtttaatataagattaaaaattttaagaaaaatatagataaaaatctataaaatctcttaatttaactaaatatctctattttatgctatatttttaattttaacattttttcataaacaattacaaaatattatcaaaattttcaatttaaaacacggcagagatttttaaaagttaaggaggaggattattttgtcagcagaggaagttttagaaaatataagaaaagagataataaaaaaatcaccaaaagaggcgaaaatagttgatgttcagtttgaggggcctgaagtcgttgtctatgtaaaaaatccagaaattttcacaaatgaaattattaaaagccttgctaaggatttgaggaaaagaatttccataagaccagacccatctgttttagttgagccagaaatagctaaacagaaaattttagaaattgtccctgaagaggcagaaataactaactttgtttttgatgcaaacactggggaagtcataatagaatcaaagaaacctggattggttataggtaaagaaggaaaaacactggaaatgattaaaaaagcaataagatgggcacctaaaccagtaagaactccaccaatacaatcagagacaataaaagcaattagggccacactttatagggagagacatgaggttaaagaaattttaagaagaattggaaggagaatacatagagatatagttgttagaggagattattggataagagtatctttcttaggaggagcaagagaagttggtaggtcttgcttatatgttcaaacaccagacacaagggtattaattgattgtggtatcaatgtagcatgtgaagataaggcatttcctcactttgatgctccagaattctcaattgaagatttagatgctgttatagttactcatgctcacttagatcactgtggttttattcccggtttgtttagatatggttatgacggtcctgtttactgcacaagaccaacaagggatttaatgactttattgcaaaaagattatttagagatagctaaaaaagagggtaaagaagttccttacacctcaaaagatataaaaacatgtgttaagcacacaataccaattgattatggagttacaacagacataagcccaacaataaaattaaccctacataatgctggacacgttttaggttctgctattgcccatttacatataggagaggggttgtataacttagcctatactggagacatcaagtttgagacatcaaggctgttagagccggctgtttgccaattcccaagattagaaacattgataattgaatctacttatggggcttatgatgatgttctgccagagagggaagaggcagagagagagcttttgagggttgttagtgaaacaacagatagaggaggaaaggttttaattccagtatttggagttggaagagctcaggagttaatgcttgttttagaagaaggatacaatcaaggcatatttaacgctcctgtctatttagacggaatgatttgggaagctactgctatacatactgcatatccagagtatttatcaaaagaaatgaggcagaagatattccacgaaggagataatccattcttatctgaagtatttaagagggttggaagcactaatgaaagaaggaaagttattgatagtgatgaaccatgtgtaatcttagcaacatctggaatgcttactggagggccgagtgttgagtatctaaaacacttagctccagatgagaaaaatgcaataatatttgttggttatcaagcagagggaactttgggtagaaaggttcagagcggttggaaagagattccaatcattacaagaaatggaaagacaaaatcaattccaataaatctacaggtttatacaattgaaggattttcaggacatagtgatagaaagcagttaattaagtatatcagaagattgaagccttcaccagagaagataattatggttcatggagaagagagtaagtgcttagattttgcagatacagttagaagattgttcaaaaaacaaacttatgtgccaatgaacttggatgctataagggttaagtaattaattttatgtgcctttcaaaactgtttaattctatttgttaaattttttcaaaatattaaaatcaaatcaattcggaatgaaaatttattaattcattaattttacattcatccttttttatatttggttaaaataagcctttagcattattttactgttcaataattaatttaaatatataaactaaaggtaaagctttctaacactatttatattagaaacgaccatacaaaaaattaataatacttaataccaaagaattcgtgggggagggatatactatggactacataaacttaaactacagaccaaatgaaggtgatttgttatcttgtatggtaattaaaggagaaaatttagaaaagttggcaaatgagattgctggggagagctctattggaacatggactaaagttcaaacaatgaaaagcgatatttatgaaaaattaagaccaaaggtttatgaaattaaagagattggagaagaaaatgggtataaagttggactaataaaaattgcctatccattgtatgattttgaaataaacaacatgccaggagttttagcagggattgcaggaaatatatttggaatgaagatagccaaaggtttaaggatattggactttagatttccagcggagtttgttaaagcttataaagggccaagatttggaattgaaggagttagagaaactctaaaaatcaaagaaagacctttactggggactatagttaaaccaaaagttggtttaaaaactgaagagcatgcaaaagttgcctatgaagcatgggttggaggggttgatttagttaaggatgatgaaaatttaacttcccaagaattcaataaatttgaggatagaatttataaaaccttagagatgagagataaagcagaagaagagactggagaaagaaaagcatatatgccaaatataacagctccatacagagagatgattagaagggcagagattgctgaagatgctggaagtgaatatgtgatgatagatgttgttgtttgtggattctctgcagtgcaatcatttagagaagaggactttaaatttataatccatgcccacagagctatgcatgcagcaatgacaagaagtagagattttggaatatccatgttggcattagctaagatttataggttgttaggagttgaccaattacatataggaacagttgttggaaagatggaaggaggagaaaaagaggttaaagcaattagagatgagattgtttatgataaagttgaagcagacaacgaaaacaaatttttcaatcaagattggtttgatattaaaccagtatttccagtatcttctggcggagttcatccaagattagtcccaaaaatagttgagattttaggcagagatttaattattcaggcaggaggaggagttcatggacatccagatgggacaagagctggagctaaggcaatgagggctgctattgaggcaattatagaaggaaaatcattagaagaaaaagcagaagaagttgcagagctaaaaaaggctttagagtattggaaataaataaaagggagacttatgaggttaaagttatccctaactcctaaacaagatttttcttttgataaaattaataaacatactatacagggttttatttattctcttttaaaggatactgagtttggggagatgcataatcagccaaggtttaagttttggtgtttttctgatatatttccaccgaatgattttgttaaaggggaggataaatatctactaatatcctcaccaagggaggagtttattaatgtattatatgagagattagataatttagaagaagttaatttaaataattttaaatttgaagtttctgaacttaaaaaatttgatttgaaggttaaaaataagtttataactggttctccaattgttttatacaaggataaagatagaggagagtatataaagttttatgatgatgattttgatttgatgttttttgttcaaagactgcaggataatgcagttaaaaaatataaagcattttataatgaagagccagttttaaatggttttatttttgatagaatatctccaagagttaggaatgggagggtagatgtttatgttaggattgctaagaagggaagagagtttttagtagttggaactacatggaagttattagagaagattaaaattagaaaagaagagaggaagttttacaagtttataatggattgtggtttgggagagaagaatagtttaggcttcggattcataaatcctataaaataagtttgaatatttgattttataaaatgcataagaaaagtttttattttttgaagtaataagttatttagattttgtttttaaagatttttgaccaatatttttaaatttcattggataggagttctctgtttaattttaataatcattttaacaaaaaagtattaacttaaattggatttggatagaagggagatattttttaaagataaaatatactttcatcttattctttgattaaaggtttttttatttgcttagaaataaaataaaaggttttttgtttgaatttaatattggttattaagattattgaataggaagggtataaatatgagttatgatacatttgaatgtaatgggtttaagaaaaacagtattgtatggaaactgttttggattaatttgtggaatgtaagggattattaagtggacttgtttaagaagaacaatattgtatggaaactctataggttttgcatttataacaatccctgaaacggggacttcaaattcgtttaagaagaacaacattgtataaaaataaaacattaaacttaattttttaaatttattaaaaaaagcaaaataatatttctcttttgattgtttaaattaaaaaaatagaaagcttaatctcttggttttacagcaacaactcccaacgcttcttcaacccttttaacatttacaaatccaactttcctcaacctctccataactcccttctgtaaatcctttcctctatacttctttcctggattaccaacataatgaaacaatcttcctcccggctttaaaactctaaaaatttctttatagaattcttcgctgtatagatgtccagctaagctgaaccttggagggtcgtggataacaacatcaaactcctcatctttaaatctctttatgacatcataagcatctcctaaaataattttaatgcctcctttaaacagctcttcactataagggtttattttagctaattctaaaacatttggatttttttctatagttataacttcagctcctcttctatacgcctctatagctgtataacccaaacccatgcaggtatctaaaactttttctcccttctttacttttacggcatttatcttatttagtgtatcttcataaggattaacttctttagttctatgcattcttattccatttatctcaattgttggtggaattgttggaactaacttataatagccgttatttgatattgcagctttaaaaacttctccatcttttataaagtatatatgcccctcatccttggcaatcttctttaaaatgtcaaagctaacatctccttcaggaaatttggcaatctttttttccctatctatcaaaatcttttctttcttttctgtcttatttaaatccaaatttaaaaaaatctcctcagattgtgaatttaaaatttccttagctatttttgaggttatgtaattcatagttagcaccaaagtaattttactcaattctgaattaaatcgataagtatatatttattttattgccataaatatttatcatggatgtcaataatctattataatttataatcattagtatttttaataagggggtttttatggaactaacggttgtgcagagagagatattacaagaacttataaacctatatagagaaaaaaatagaccaatcaaaggaacagaaattgccttaagattaaataggaatccaggaactataagaaaccaaatgcaagctttaagggcattagatttagttgatggtgttcctggacctaaagggggatatgtgccaacaagtaaagcttatagagctttgggattagaagatgagggggagataatagtccctatatataaagatggaaagaaagttgagggagttaaggttgtaaaaatagagtttgacactgtttcacatgaaaaatgctgttcttcaaagatacacattgagggggatacaaagcactttaacattggagatattattagagtcggccctacttatcataataaaattattattaatggaaaaattattggaagggatgatattcataggattttgctaatagatgttttaggagtttcaagtatcccaaatataaaagttggagatgtggggattaaagaggtttggacaataaatccaaattgcactttaagagaaactgccaaattatttgctgaaaaatatatcagtggagctccagttgttgataacgataaattggttggtgtaataagcctacatgatattgctgagaatatagataatattgataaaaaggtcaaagaggttatgagaagagacgttataacaatacataaagatgaaaagatatatgatgcattaaaaattatgaacaaaaataatgtggggagattggttatagtcgatgataacaataaaatcgttggaattataacaagaacagatatattaaagattattagtggtaaatttccagagaatttccatacttaatagaacctaagtaaagcatatatatcatttcaatcaatactacactacggctataaacaaggatagagatttttgtattaattaatttaaactcaattttatctcctaaatcttaaattttcttaatcaatttttgatgaggggtaactatgattgaaattataagactatggctaaccaaataacggaactgcattgccgttttatttggctgtgccttttttaaatcaaaataaatatttgtgagggatagctatggttaagattgtagatactacttttagggatgctcagcagtcattgatagctacaagaatgagaactgaagacatgctaccaatagcggaaaagatggatgaggttggattctactctatggaggtttggggaggagctacatttgatgcatgtataagatatctaaatgaagacccatgggagaggttgagggctttaaaaaagaggattcaaaacactccattacagatgctcttaagagggcagaacttagttggttataggcactacccagatgatatcgttgaaaagtttgttataaaagcccatgagaatggaattgatatttttaggatttttgatgctttaaacgatgtaagaaatatggaaactgcaataaaaacagctaaaaaggttggggctgaagttcagggggctatatgttacactataagcccagttcatacaattgaccaatatgtggagttagcaaaaaaattagaagagatggggtgtgattcaatctgcataaaagatatggctgggcttttaaccccttatgaaggatatgagttagttaaaagattaaaagaagagatatcacttcctattgacgtacatagccattgcacaagtggtttagctccaatgacttacctaaaagttatagaagctggagctgacatggtagattgtgctatctcaccatttgccatggggacatcccaaccaccaacagagagtatcgttgttgcgttaaaaggaacaaaatatgatactggcttagatttaaagctcttaaatgagattagagattacttcatgaaagttagagaaaaatataaaatgctattctctccaatatcccaaattgtcgatgcaagggttttggtgtatcaagttcctggaggaatgctatctaacttggtctcacaacttaaagagcagggagctttggataaatttgaagaagttctacaggagattccaagagtaagaaaggatttaggatatcctccattagttacaccaacctctcaaattgttggaactcaggctgttttaaacgttttaactgaagagagatacaagattataacaaacgaagtagttaattatgtaaagggcttttatggaaagccaccagctccaattaacccagagttgttaaagagagtattggatgagggagagaaaccaattacctgcagaccagctgatttattacctccagaatgggagaaagttaagaaagaggcagaagagaagggaattgttaagaaagaagaggatatattaacctacgctttatatccacagatagctgttaagttcttaagaggagagttgaaagctgagccaataccaaaagagaaggatataggaaagattttagagattccgactgaatatattgtagaggttgatggagagaagtttgaggttaagatagagccaaagattggaacagaattgaagagaaagaaagaagttataactgcagagatggagggagctgttacttcaccatttagaggaatggtaactaagattaaagttaaagaaggagataaggttaagaagggggatgttattgttgtattagaagctatgaagatggagcatccaatagaaagcccagttgagggaactgtagagagaatattaattgatgaaggagatgctgtgaatgttggagatgtaattatgattattaaataaacttctctttttttgtgatattttggtgatatttatggaaaaaagatggaaatgtccaaaatgtggaaatacagaattttttgaaaaagaagttgcaatgactggaactggattatcaaagatatttgatatccaacataacgaatatattgttataacatgcaaaaaatgcggatattctgaattttatgataagagtatagtcaagagtaaggataatttaatgaatattttagatatcttctttggatagaggtgaaaaatcatgtttaacaaagttttaattgcaaatagaggggagatagcgattagaattataagagcatgttgggagttgggaattaagacagttgcagtttattctgaggcagataagaggtctttacatgctactttggctgatgaagcttactgtataggtcctgctccagcggcaaagagttatttaaacattgatgccatattaaatgtagctgagaaagctaaggttgatgccatccatccaggatatggatttttagctgaaaatgctgaatttgcaagggctgttaaaaaagctggttttgaatttatagggcctaatccagatgctatagaagcaatgggaagtaaaattaacgctaaaaaaatcatgaaaaaagcaggagttcctttaattcctggtagtgagggggctattgaagatattgatgaagcaatagaaatagctgaagctatcggtttccctgtagttgttaaagcttcagctggcggtggcggaatgggaatgagtgttgcatatagcaaagaggagttaaaagaagttattgaatctgcaagaaacattgcaaagagtgcatttggtgacccaacagtatttattgagaaatacttagaaaatccaagacacattgaaatccaattattgggagataagcatgggaatattattcatttaggagatagagagtgttcaatacagaggagacatcagaagttgattgaagaggctccctcaccaataatgactgaagagttaagagaaagaatgggagaagcggcaatcaaagcaggaaaggcaataaattatgacagtgcaggaactgttgagtttttgtatgaaaatggcaacttttacttcttagagatgaatacaagaattcaagttgagcatacagttacagagcaagttactggaatagatttggttaaggcgatgattaaaatagctgctggagaagaattaactttaaagcaggaagatgttaaaataagagggcatgcaattgagtgcagaattaacgcagaagacccattaaatgatttcgttccatgtcctggaaagataaaactatataggtctccaggggggcctggagttaggattgacagtggtgtctatggaggggctgaaattcctccttactatgattcaatgatagctaagctaattacttatggaaatagcagagaggaggcaatagcaagaatgaaaagagctttgagggagtatgttataataggcgttaaaacaaatattccattccatagggctgttttagaggaggagaactttttaaaagggaatatctcaactcactatgtagagcagaatatgcataaattaagagagaaaatggttaaatacgcattagaatcaagagatttatacagtgttgtatcagagaaggtatttgaaaagaataaaaagatagccgccgctgttggtggtttaacaatgtatatatcccaaattatgaaagaaaatgaagtgaataacaaagaatggtaactatctaaaattttattttttatatgcttaaaagatagaagttattgaaattttgttaaatttgaatattaaatttaatagattaataagattaataatctcaaaaactcagaatgtgttgatagtaatatttatataacataaggcaatagttattaaaagtttcttttttagaaaataaaaggtgataataatgccaggaacaaaacaagttaatgtcggttcattaaaagttggacagtatgttatgattgatggagttccatgtgaaattgtagatattagcgtttcaaagccaggaaaacacggaggagctaaggcaagagttgtaggtattggaatatttgaaaaagttaagaaggagtttgttgcaccaacatcaagcaaggtagaagttccaataattgacagaagaaaaggacaagtattggctataatgggagatatggttcaaattatggacttgcaaacttacgaaacattggagttgccaattccagaaggtattgaaggattagagccaggaggagaagttgaatatatagaagcagttggtcaatacaagataacaagagttattggtggaaagtaaattttaattttaatttaaatttcaaaagttccatttatggtccttataacaacattatcaatatatttctttgctattttacccaactctctcaactcattttctttaggcatagggagttttttaaattcttcatcataggcatcctttggctcaaactgctgaattgcatataagtcacagtctttaactgtttttgctatatcttcaatatcttcctcatccataacttttgggacaaaagttgttctacactcaacaaatacattattttttttgcataaatcaataatctttaatatcttatttttaatctcctctccatcctctctgcattttacaaactctttatacttatcaaatctacattttacatcaatagcaacataatcaataagcttatttttaattagctcctcaataacctctggatgtgtgccgtttgtatcaattttcactggaaaccctttttctttagcatatcttgctatctctatcacagcatctttctgcagagtaggttctcctccacttatgacgatagcatctgcaaataaaaaatctatatcattaaaaatttcctcaactgtcatccccctcttatgctccaacataaactttaaattgtggcaataagggcatttcatattacatccatatagaaatatgacagctgaagctttttttggataatcaattgttgataaatctactattcctgaaactaaagctttcactttatcacctaatcaatttttagtctttttagcaaaatcattttaatctcatcgttaattaacatccaaacatgggcatagagccacataaacaaagccaaatcccaaccaattggagccatgaatattccttcagcagctacaattgttccaataatatttgttcccataactccccagaacagcaacttacttggatatggctttttccacaacctatctctaattcttgtaacgaatatggttgcatgtccagccaatatcaactttaaaaatacaaagctctgcaactctgcaattgttagatgtaagaatacatcagatatatagaatatcaggaaggagctaacaactccactcagtcctaaagcagttgagagcattaaaatctctctcatcctccatctaactggagattttggctcaacaacgttatcataggcgattgccaatatagggatgtcattcaatatagctaagagcacaatcatcaatgcagttattggataaatgcccaaaatcaatatgcataactcaacaaagaataaaatccttattgtctcagtaattctataaataacatagctttccattctttgaaatatccttcttgcctcttggattgcatcaacaataacagatattccaggagataataaaactatatcagcagcggctcttgcagcatcagttgcatttgaaacagcaatcccacagtcagccttttttaaggcaggagcatcattaactccatccccagtcatggcaacaagatgccctctcttctgcagtgaatcaacaatcttatatttatgctctgggaatacctcagcaaatccatctgcttcttcaacaatctcatcaaatttttcttctttaatctctcctctttttagttttttcaatagctcactaattgatattatcttgtctccaatgcccaacattcgtgctatattcttagctatagctacatggtctccagtaaccatctttattataactccaagctctttaatcttcttaactgccaaaggagcatcttctcttggagggtcatacaatgggattattccagcaaagtgccatctcccatttttataaacagctacccctaaagccctataaccattttcagcaagcttatcaacaatttcctcaacctttctccttaactcttcatctgcattgcataaatctaatataacctgaggagctccttttgagactttaaactcctcatcgttagttacctctgcctctgtcctcttaataactgggtcaaatggaatgaacttctttattttgtagttttttattttttccatcaatcctaatttcttagcctcatttaaaattgccatatctattgcatcagcatcctcttcccttgaagcaagagcggcaaataaaacaacatcctctttactaaatccatttaaagctataatttccccacacacaagctgattctttgttaaagtcccagttttatctgagcagagaatatcaactcctgcaagttcttcaatagctacaagtttcttaacaatagcatccttctttgctaaatttaatgctccaatagccatagttattgataacacagctggcatagccgctggaattgctgaaacagctaacactaaagcaaattgggctgtttctattaaactctttcctctaaacaattcaacggcaaccattattgctattaaaattactgctaaaactatcaaatagtctcctatcttgataatcatcttttgataagagctaactttttctgctttttcaactaacttaacggtctttccaaagtaagtatttagcccggtagctttaactattccagtcatctctccttttttaacaatagagccagaataagcaatatctccaatcttcttctctactggcaaactctctccagttaaggcagattcatctacaactaaataatctccatcaaccaatattatatcagctggaacgatatctccaatcctaattctaacaacatctccagggactaattcttttgctggaattatttgccattttccatctctcaaaacccttgcatttaaagccatcttctgctttaaaaactctatgacattttctgccttatattcttcccaaaaaccaacaacaccattaaccaacagtagtattaagattataacaaaatccacccagtgtttgattattgcagataaaatagcggcaatttcaatcatccaagcaataggattccagaagtaagagagaaatttaataattggatgaacctttttttctgggatttcattatatccatagatttttaatctcttcttagcttcttcagttgataatccagtttttatagaagttttatattcttcttcaatttcctcaacattcataacaaccccccacaaaaaataaaaaataatttatttaagcaaagtattttaaaacatccttctctgtgataattccttttatccttaagttttcatcaactactggtaaagcccctatatcattggttaccattatttcagctatcttctttaatttatctccctcttttgcagttataacatccctcttcataatctcttccattctaacatttgttatctctctaacattaccagtttgcatgtggttgaaagcccaatcactacctaaaagttttataaagtccgttgatgttataatccctaccaatctcccctcactaacaactggcagtcttctaaacccatttctcaccatagttctcgcaacatctttcaacctctctcctggtgtggctacaataacgtcccttgttatataatcatcaataacctcattttcgtctatcttatccaataaagcccttatcacatctctttctgtaattaatgaaatgagttggttctcgtcattaactattggagcccccccaacattttttgttaagaatgtctctattgcttcatcaatatctgcattctcctttaaagttataacattctcctccattatctctctaactggttcatttattgctgctaaaaaattcctttcatgcttctctctaattaagttgtattttgaacccccacccatgaaatctacaatatccatacttgtaattataccaacaactttgttatttcccgcatttaccactggcaatcttctgtatttattctcattcatagtcataagggcttttcttattgtagttgtaggataaacagttacaatctttttattttgggcaattttcatgactctcacaaacatccctcacaggaaattttcaatagtttaaatttaaatttgaattcttacacataatattaatatttcatttaacgtataaaatgattatccttgtgatgagtatgagagatgtagaaaagattataaaaggaataataaaagatatgaatccaaggtttaaaaggaaaactttaagagagttattgagtgaagaaaaaccacatgtaataataaacggtaaaaggcataggataaaaaggagagagcttgagtttttaaaagagatagcaagtgaagatttaaaaatccctattgttttagaggttgattcctctttaggaggggctataaaaatcagtggaaaagaagaagtaaaagttatatcaaagattttggggaaagagattgatattttttcagagaaggatgtaatgtatatatataaaccagaactaaagattgttagaaaagaactgccgacaacaacacagcttatatttaaattatctttatttgactaaaaagtgataattatgaaaagaaaaaaatactatgggaaagacccaataaaaaagcttttaaatgacccggaaaagagagaaaagatttttaaatttttatttattttgaatatatgggtttggttgatggtatttttaggggcggtgatttttatcatattgatgataaagtattattggtgaaattttggatgatgaaaaactgactaaaaagagagaattactatttaatgccatttttgacatttataaaatatttcttggagcaggattgactttattagttgctgtcgttattaaggtttcattttctgaaggtagttttaatattggcttatcactaattttaacagatataacaatcattatttacattagcttgctgtttggagcaattttatatgatatttataaaagattgtaacttattgtatcaacttccttccaactttccaataccagactgcaatagctgtagcaaacaatgccataaatcccaatataactaacaccaatattgcaaaggcatccaactgcatacttccaacctctttttataaccaaaaagattattaactttaagttatctaagttaatatttaactgataattatatttataacttttatttggtggtagtatgaatatctatgtttggttatttgctattatagctctaagcttctctgcattagtgggattaagattatcatttaaaaagggaactgccaatgttttagttggggagtcaataattaccgttgttgctgggacgttgatagttgttatctcccaaaaatacaaccttgcatttgccgatactatagccttagccatctttatatgtggggttgttggggcatttgccttctgtaaggttataggtggagataatgaaaaagcaaaacagccaaattaatgagattaataaagatgagatatttgtagtcgttcctgcattcaatgaagaaaagatgattggagaaactttaaagaatttaaaaaaagagggctataaaaatatagtagttgttgatgatggttcaatggataaaacttcagagatagctaaaaaagagggagttatagtctgtaggcatatattgaatagagggttagggggagctttagggactgggattaaatgtgctctgctatataaaccaaaaatcatcattacctttgatgcagatgggcaacatcatccaaaagacgttgagaaggttgttaagccagtattatttgaaggctatgatatggctattggtagtaggatgatggataagaatgagttaaagaatatgccattagttaaaaggattgggaattttggcttaaattttataacttatttgatgggagggtattttgttacagacagccaaagtggattgagagctttctcttatgaagcggctaagaaaataataggggatttaaagagtgataggtatgaagtttcctctgaatttataattttagctaaaaaacatggattaaagcttaaagaagtgccaataaaaactatatatactgaatattcgatgagtagaggaactaatgtaataactgggtttaaaattttatttaagttgattatgcagaagattttttaaaatggaaaaataagagtttttaatattttattttttgatttatctttccaactttgtattttaagccaatgtagccaccaacatctaataacactatgtttatagccaacagaatgaaggttatataaatcagatataagtccatggtagctaaagccatgcccattaataaagctgggattaatattgaaacatcaattgtaactccaatgatttcatactcctttccgcttgcaatactcattccccctgaaatacctgcaataattgcaacaatagcactcaatattattgatgtctctgatagatactgtaaaaccaactcttttgaaacaaaaaacaaacttggaataaatgcacaaactataacaatcccagagcagaggagttcttttttcatcccttggatgaataactctttatctcccaatactgttcctatggcacttcccataactgtatcaactaaaggtgctataatcatcgccccaattaatgttggaatattatgctctatcaatccaataactcccatgatacttgccaatataactttaattataacatttttcgtaattttaaccatagtttttgctttgtagtagagttctaaaggagacaagcttgttgaagctattccctcctccctacatgagaatgttatgtttgctggcattattgtcacacttccatgacctttctctcctaaacctaatttttttaattctaaaactattttttctgcatctcttgcatctgcgttgcatgttatgatgattccatcttcaattgatgtctttaatggttcaattattgatattgagtaggcattgttcttttttaaaatttcctcaacagtatttaggaatttttttggaatgatgattttcatgtatctcattctctcaccaaaccacaacctttatatacaccctacatccaattacatagtgaaaacattaaaataactatctaagttggtgataccttgaaacttagaaatgttgaaccaaggtttttgaaagcatataatatattaatggataaatttgggctattcccatttacctatgatatggctgaaaaggttcttaaagataactatgaaaatgtgaatgaagtattatccaagttggctgatgctggattattggaaaagacagcaaagaaggaagataaaagaaagaaaatttataaaataaagccattaactactgaaaaaattgaaaaggtaagtaaagataagttaattggtttgcttaagcaaggggctgatttgataagaacgcaggtagattataaagtattactgttatttttgttttttaaggcaattagtgataaatatctgttaaaagttgaggagttgaagaaggagtttgaagatttggatgaagaagatatatatgtattggcaaatgaggaaattttagagctttatgatgttgagggtaaaaagttgtatgtatggcatgaagtagcaaataatccagaagattttataaatgcattaaataaaattgttgagatgaataaggagaaattgagtggtttagatgagttgataaaaagaactggacttcctacattatttgaaaatgaaaataggcatattgttcaacatttaattaatttatttagtagagcagatttttcagaagcatcttatgatatattgggagatgcttatgaatggactttaaattattttgctccaacaaaggcaaaagagggggaggtttatactcctattgaagttagcaaactaattgcccatttggttgaaccaaaagacgatgaggtaattttagaccctgcatgtggttctggttctatgttgatagagcagtatagatttgcaggtagtaatccaaatattgtgttggttgggcaagaaaggaatgatgttactgccgttttagcaaagttgaattttatactgcatggaattaacttaaaagatgctaaggtgtttattggagattctttactaaatccaaagtttgagagttttattnaagaagttaaaggtactggnaaagctgataaggttgtagcaaatccaccatggaatcaggatggttacgatgaaaacaccctaaaagtgaatgaaaaatataaagatatttatatgtatggatttccaaataaaaactccgctgattgggcatgggttcagttgataaattattatactgaaaaaaaggcggggattgttttagattcaggggctttgtttaggggagggaaagagaagacaataaggaagagatttgtagatgatgatttaattgaggcagttgttttattgcctgagaagttattttataactgtcctgcaccagggattattttaattttgaataaaaataagccagaagagagaaaaggaaagattttgtttataaatgcctctaatgaatatattaaacatccagaggttaaaaaattaaacaaactctctgatgagaacattgagaaaatagcaaaggcatataaagagtttaaggatgttgatggcttttgtaaggttgtagatattgaggagattagaaagaatgattataatctaaatgtttctttgtatatctctccaattgaagaagatgaggatgttgatttaggagaggtttatgaagagcttaataaattgcataatgagtatttggagaagtttgaggttgttaaaggttatttagaggagattaatgggttgattaaatagatatttttttgagggattttaagagctggaagttaatttaatttgtttgattgattagaaataagtaaggtggttaatatggctccaaatacaaattttgccagtttagttgcagtagctggatgtgttttgttaggatataattactatacaggcaatatattttgtggagttataggttctttattattatttggagctttatggagcctaaatggaggtaaaatttggggtattatatcgtttatcatatcagcaagtattttctgttatataaattgggactttatccttaatttgttattctattcgattattgcttttatagttatgtccatattgattttaatttttgggaataatcgtggaggatattattactaaatactattttttttggtgataattatgcaattttataaagaagagaattttaaagagatgcatgggttgagagttccagaggactgggaagttgtaagaattggagattttataaaatatattaaaggtaaaaaaccagctgttatggtagatgaagaacttgaaggttattatccttatttatcaactgagtatttaagggatggaatagcttcaaaatttgtaaaaataaccaataaggaaattattgtaaatgagaatgatatactgctattatgggatggttcaaatgcaggggagatatttttaggtaaaaaaggaattctttcttcaacaatggtaaaattagaacagaaaaataaaattatggacgatttatatttattttattccctaaagttaaaagaaagttttctaaaaagtcaaacaaaaggaactggaattccacacgtagataaaaaaatatttgaaaatataaaaatccccctccctcccttagaagaacagaaacaaatagcaaaaatattaagtgactttgataacctaataggaacaataaataagcagattgaagtattaaataaggcaaaaaaggggatgatgaaaaaattatttactaaaggagtttttgagcataaaagttttaaaaaatcagagattggagagattccagaggattgggaggttgttaaattaaaggaagtagtggatatacaatctggaaaatattttaaatattcagaattttgtgaaaatggtgtaaaatgtttgaaaatcgataatgtaggatttgggaaaattttttgggaaacagtttcttttcttccagaagattatttgaataagtatccacaattagttttaaaatctggagatatagtattggcattgaatagaccaataataggtggaaaaataaaaattggaattttaaaggatatagatgagccagctatactctatcaaagagtaggaagatttatttttaaaagtgaaaagatagacaaacagtttttgttttatttgttaatgagtgaatatttcaaaaaagaactttctaaattgcttattgggactgaccagccttatataagaacacccgtcctactaaacataaaaatccctcttcctcacttagaagaacaaaaggcaatggctgaaagattaaaaagtatagacaacctaatagaaataaaaagaaaagaaaaagaacaaatagaaaaagcaaaaaagaaaataatgaatctactactaactggaaaaataagagtaaaaaatttaaatttttaaaataaaatttttattgttaataaaattttgctggtgaaattatgaaaactctctctgaaataaaagaaatcctaagaaaacataaaaaaatactcaaagaaaaatataaagttaaatctatcgctatatttggctcttatgcaagagaagaacagaaagaaacatcagatatagacatattaattgactactacgagccaataagtttattaaaattgatagagttagaaaattacttatcagatttattgggaattaaagttgatttaatcactaaaaactccatccacaacccttatgtaaaaaaatccattgaagaagacttaatttatatttaatggtggttaaatgccgaagagagatataaaggcatttttatatgatattttagagtatatggatgacataattaactttactaaaaatatggaatatgaggagtttataaacaataaggcaataaaatatgcggttgttagatgcttagaggttattggagaggcggttaaaaagataccaaaggatattagagaaaaatatcctcacatcccattcaaagaattggctggaatgagagataaattaatccaccaatattttggtgtagattatctaaccgtttgggagacagcaaaatatgaaattccagagataaagaaagaatttgaaaagattataaaagacattgaggggaaggatgaaaactctctctgaaataaaagaaatcttaaggaaacataaaaaagaattaaaagaaaactataaagttaaatctatcgctatatttggctcttatgcaagaggagagcagaaagaaacatcagatattgacattatggttgagttttatgaaactccggattatctcaaattctttgagttggaggattatttagagaatattttaaatatcaaagttgatttaattacaaaaaactcaatttaaaatccatacattaaaaaatccattgaggaagatttaatttttatttcaggtgaataaaatgccgattccggagatttacgtccataatgatatagaagagaatttaaataanttaggttggaaagaattggagggatatgaaggggaggcatttagcaactacataataaaaccaatattagaggagcaactaaaaattataaacgaccacataggagaatataaagatgaatttattgagaaagcaataaataaactaataaatganccaaaaccagaggagattttagattatattaaaaatggaatattaataaccttagataagggaagaaaagggcaagtttctaatagagttaaattaattgattataaaaatattgagaaaaatatcttcaattatgcccacgaattgaaatttaaaggaaacgacaacattatcccagattttaccctatttattaatggaattcccataattattatagaggcaaaaagagaattttctgaaaaagaaacttatgaagaggcgataaatcaaataaatagatatgaaagggaagctcctaaactattcaactatgtgcagtttgccattgtttatggagatgaaaaactttatatcccaacatatccaaacgaagaaaaagaagatagatttaaaaagccatacaaatggaaaaatgagaaaaaagaggaagatatttgggatttattaaaaagggagagagttttagatacaataaagaactttatattttttagtaaagacagggctggaagaaaaactaaaattatcccgagatatatgcaatattgggcagtaaaaaaagcttatgaaagaataaccaactacctaaacaacaaagattataaaaataggggattagtttggcattggcaaggtagtggaaaaaccttcgaaattttatatttggcggagttattttataatgaatttaaaaacaaagaccctattgtttttataatggtggataggagagagttagagactcaatttaatgatgatatcattgccttacaaaatgcgaattttaaagattgcttcaaaaaaattaacagtgttgaagaacttaaaggagttttagaggacataaaagagtcagaaaataacccaaatatttcagagaagggcgtttatttggttatgatgcacaaatttgataaaaataaattaaaggactttatagaatcttttggctcaattgataaaaaagaaattttgattttgagggatgaagctcatagaactgaatcaggtaaatttgccaccctaagaaacaaaattttaaaaaacgccattgccattggttttactggaactcccgttcataaaaaagatatgagcacatttaaagaatatgcctatccacaagaaggagagttttatttagataggttttttattgaggaatcgataaaagagggctttactttgcctttaatctggagagttgttaaaccagaggatataaaagatatctcagaggaagaaataaaaaacattatagaaaaattgtttgttgatgaagaagatgctgataagattgttgtatccaaaaaagaaattgccgagaaaataaaattatctgatttattaaaaagtgaaagcagtataaaagaggcatcaaaatacatagcagagcatattttagaagacactgaaaactttaaattcaaagccatggttgtagctcaagatagaaaatcatgcattttgtttaaaaaatatttagacgaatatcttaaggaaaaaataaaaaactacaatgagaactggactcaggttgttattacatatattcacaatgatgatgtagaaattgagaattataaaaaagagattgaaaaaaaatatggtaaaaatgtagatgaattaaacaaaaaatggactgaagattttataaataaagaaaatccaaaaattttaattgtcaataaaaaactattgaccggttttgatgctccaatattaaaaactatctacatccaccaatttcttaaagattatctcttacttcaagcatctgcaagggcaaacagaccagcaaaaaataaaaaatatggacttattgttgatttaacaggaatattaattgaaaactacaaaaaggcaattgagaactataacctatacagagatgaagcaataaataaggatattttaaacaacttatttgttgaaacatcaaaaatctgggagagctttttaacgaagttaaatgagtttaaagagttgtttaagttaattgtagggattgagtttgatgatttcattgtaaatctaaaaaaacagaaaaactcaaaagaatttaaaaaaattataagcaaaattatcctaagtgataaatttgactatttctatgcaaaacttagagaacttattcaattatttgaggctgttggggcttatggagaaaagttaaattattacgaaacctatgaatggctaaaaataatatctgctggaataaataagcagatgagacctaaaagttataaaattccttacaatcaaataaaaaaggaagtaataaaatatttagagtttgatacttatgcagacattgcttcaacctcaataaatcctcaactattggagaatttaaaaaataaagatgaaattaatgtaatagttgcagatatgatctattatgctttagatacacttcaaaataaaaaagagccaatatataggatgatatacgacagaataaacgagttaaaaaacgcatatatttcaaaaactaaaaaaaatgagtatgtgattaatgaactaataaattgcttaaatgcattaaaaacctacgaagaggaggaaaaaacattatcaaaatcagaaaaggcaataaaaaatatgctgttttatttaaagaatgtagagaactgcaatattaaaaaacttccactaactgaaaagaccttaaaaaatttggaagataaaaaattaataaaaccaagtgattttgataaaattaagaaattcttatttgttgatttgaaaaatgctattaaagaaactgaaaaaagaagaaaagtatcaaataaaatagttgaagaaattattaaaccaatttttatttaatgtgatataatgaaagatagaaaaatattaaacgaaatattgagtaatacaataaatgaactaaacctaaatgacaaaaaagcaaacataaaaatcaaaataaagccacttaaaagaaaaattgcctctatctcattgaccaataagacaatttatataaataaaaatatactgccttatttaagtgatgaagaaataaggtttattttggctcatgagcttctacatctaaaatatggaaaatatcacataaatgaatttgaagaagaacttttatttttatttccaaataaagaagcaattttaataaaccttataaacaaactgcatcagaaaaaataaaggagggagtatgtttagcataagaaagataataacaatctctgactatgtaacaatgctgaatatcataacaggacttttagctatcttactaaatagcttttcattaatctacctctcaataatctttgattctttagatggatatgtagcaagaaaaactggaactgtctctgactttggggctgagttagacagtatttcagatgtagttagctttggagtagctcctgcttatctattatataacaactttgaatcaaacttagctttgatatcagcaataatattctgcctctgtggagctttaagattggcaaggtttgggattttgaatgttaaaggttttattggcttgccaattcctgcaggagctttattgttagttggattctgccaattaattaatagctatttaattaactcaatattggcaatattaatagggcttttgatgattagtgatataaaatatccgaagtatcctaataagatatttatctatatatttgctgtctccttatgtttggctatagttggaatcccacactttgctttaatgttgtgtttaatctacgctatttatggaataatcaaatatataagaggtgattaacaatcaacaaagaaatcctcaaaaaaatcccagagaatattttaaataaagatgcaataaacaaattagaaaataaaggagtaaaaattgtagatgttttaggaaaaggacatagaggggttgtattaaaaggcatatacaataacaaggaggtagccataaaaatcccaagaacagacagcccaaaaaacaccatagaacatgaggcaaagattttaaaactcttagaaaaatatgacatagctccaaaggtttatgaatttgatagcgattatttaatcatggaatttatagatggagaggagttaaaatcagccgttgataaattagataaagatagattgctaaaagtagttgaggatattttaaaaattactctaaaacttgatatcttggggattgagcataaggagatacagggagggaggcattttttaattaccaataaaaaaacctacatcattgattttgacaaagctaaggaaaagaaaaccacgaaaaacttcactggagctatagctttattgtttggagaaggaagaatagcaaaaaccataagagaaaatctaaatattggaattgatgaaataaaatttataagggagtttgcaaaaaaatataaaaagctctaatgataataaattattaaggtgatgtttatggttaaaattatcacaagaaaggtaaaagacatcgaaccattagaaaatgcgttattaattgaaggactgccaggaattggacacgttggtagattggcagctgagcatttagtccatgaatttaaaggagagaagtttttagaactcttctgttatgacttcccaccacaagttttggttaaagatgatggaactattgaatatatgtgtgccgaattctatgcaattagagagccaaagccaatgattgttgttttgggcaacactcaagcgttatccccaattggtcaataccacttagctgaagagattgttaaaataggcatagagtatggagctaactttgtctataccttaggtggctttggagttggaaagctatgcgaagaagttaaagtttatggagctacaacatcaaaagaacttgctaaaaagttaaaagagcatgatatcttattcagaactgatgggggaggaattgttggagctgctggtttaatgctgatgtttgcagatttaaatggaattcctggaatctgcttaatgggagaaactccaggctatctaatagacccaaatgctgcaaaagcagttttagaaaagttctgcaagcttgaaaatatagagattaatatggaagagttggagaagagagccaagggcatggagcagtttattgagaagattaagaagtttgaagaagagatgctaaaagctgcccaggcaaaaccaccaagtgaagaggatttaagatacattggataaacaattaactttaaatattatcttctctttttttaattttaatggttttcccttattttattaaaaatttaaatccattttgagtgttaatctttcaatgaaggtgattattgtgaaaatctggaataaaatcaatggaataactctaataaatgatgattttttaaatgtggatttacctaatgaaagtattgatttaatagttacttctcctccatataatgtaggaattgactacaaccaacacgatgatacaattccttatgaggaatacttagattggacaaaacaatggttaaaaaaggcactaactcttttaaaaaaggatggacggctttgcttaaatatcccattagataaaaataaaggagggataaaaccagtctatgccgatatagttaaaattgccttagatgttggatttaaatatcaaacaacaattatatggaatgaacaaaatatatcaaggagaacagcgtggggtagctttatgagtgcttctgctccttatgttattgctccagttgaaactattgtagttctatataaagaaagctggaaaaagctttcaaaaggagaatctgatataactaaggaagaattcattgaatggactaatggtttatggacttttccgggggagagtaaaaaagaattggacatccagcaccatttccgttagaactcccaaaaagatgtattaaactttttagctatgtgggagatactgtcttagacccattcttgggcagtggaacaacagcaatagccgcatataaattgagaagaaaagctattggtgtagaaatagatgagaaatattttgaattagcaataaaaagagtctcaagagaatgttgcactttggagggtttattatggaaataaaccacatatctaagattttagaaaaagagagggaagaatacattagaaataaagttgaagaatatttaaaacaaggtttttctaaggatgatgcggtaaataaggcaaatcaatcatggagnacttacattggacatagaattcaagatgttatttacaatctacttaaaaaatttttaaaagatagcggattaaaagtaactactgacaaagctttaaataatagaaatttaccagaagaattggataaagttaaaagattgatagccataaattatggtgaatatcttttccttccagatgcagatgttattgtttataaagttgaaaataatgatataaaaataatagcaatcatttcagttaaaaattcttttagagaaagaagatttgaaacaacatattggaaactaaaattgaaagagtccccagtaacttcacatataaaggtattcttagccactccagataaagacaatgaaatttcttataaatgtccaaatggaaaacctaaaaagatgagaataatcttagaatacgaacttgatggaatatatttcctaaaagaggactttgaagaaacagaaaaagcaaaacattttggaaaaattgttgaagacattatagaaatttctaagaaattataatttatttagatttagaatgtagttacttttccttcaacaatcatcttttgaacttccatgatgttatctaaccatttattggctatctcttttgcttttggttcaatatcctttatatcatagctatcttcagttataatttctatatctaaagcctttggctcattgattggcttaccaatttggcttaatattctaacatagcactctttaactccttccaatttggcaatatcgtttgctattaagtttgctaagatattgtagattttaccaacgtgatttactgggtttttaccacttgctgcctccatactcataggtctgaatggagttatcaatccattaactctatttcctctcccaactgaaccatcatcccccatctctgctgatgttccagtaactgttagatagacactctccctctcataatcatctgctgtatttatatgaatttcaacctcatatccatcagctatcttcttagctaaatcttcaaccttctttctaaccttttcaataacttccttatattcctcaatatttttaacatacctatcaacaacagccatagcaatggttaaagttatcttcttaccctctcttaatcccataacctttatgtcctctcctacagctggaatctcattctttaactcatcactatttaaaaatctctctgtttctaaaactaacctctctgttgttgataatggagcataacctactccaaatgatgtatcattagctaaaggaacttcattcttttgtctctcaaagacatcaactaaatccatacttccctgcccaattctgcagtcaataataacatctttatcaacatcaacatttcttaaaaccttctttaaatattctttagcagctttaacagcagttgttcctactgggagctttataacttcatttttctccttatctaagatttccattgttgctcttccagataataaaatataaatagggcttaccattactcctcctccaaacttaggatatgcatgtccccctacaagctcaacttggtctgtattgtggtgcaaaatagttccaaacttctccatgtacatcttacataaagccctactaacactctcagcaataccatcacaaattgaatctggatgccccaatcccttcctctcaacaatttcagttggtctttcttcaattggttcaacatctaatttttttacaattatgtttctcatctatatcaccatgtcctaattatcaataagtaaaatgataaaataaattttttatatttaaagttaatcctcttataaaatagaaagctaaaaactccctaaattagaaaaaatattttattaaattctctttaccatccttaaccatcctttgacgacttctttttcctcaaaacccaatcttttatagaattctatagcccctttattctctaccccaacccacaactcaacaattctcctccctctttttttagcatattcaatagctttgtttattagagcggttccaatccctctccccctaaaatctgggtcaacaaatatttcatggatttcggcaacctctcttttttctatattacttatccaattgcaatcacaagcaacaaaaccaacaggctttccattaacttcacaaacaaaaaatccatcctcatctctcttcatcaaccatttaaaataccatcttgcccattttttctttttataataatatttatcaaatcccctatatgccttaaaataaagctcaagaaagtcatctaagtcatctttagttacatttcttattgtataggtttttattaagttataaacctccatagctgcattttgacatctgaagaaatcatctaatattgattttaatgagccaatggagtgggtttttatatacaatgtgggctttttttcacattttaaattaatttcaatgctattattaatgtagttatcaacctctaagcttctacaaacttcttttggaatttctaagtgtaaaattagctggactctcataatctcacagaaataatttaaatttattaatttaactttatgaatatatagatgtaaaataaaaaataaagattggtgcgccggccgaggatttaaacgaaccttttagtaaaaggttcatcaaaacggatgcattgcttcctttaaggaagcaatgcctcttagattaaagtggggctgaacgaagtgaagccccgctctggggtataccaataggggctttgcccctatggaaataaattatggtgcgccggccgggatttgaacccgggtcgctggcttggaaggccagagtgataccaggctacaccaccggcgcatgtccaaatcaagccctggctaattgaagccagtggtgcggcctccgggatttgaacccggggtccgggcgtggcaggcccgtgtgttaccaggctacaccaaggccgctccattgcaagcaacaataacatactcagaactactataaatacttttcggttttattgtattaaatattttaattaatgtcttgaattataagaataggcgtcaaaataaaaataattttttatactttgatttgttttattagattatgttagatattgtgagattactctcactcatgagactggtagaattttactggtgattattatggatttaggaactactaagtatatcatttatgcagaactcattgctgatggttatgttgaaaaacatgatgttattggagcaatatttgggcagacggaagggttgttaggggatgagttagatttgagagaactacaaaaaacgggaagagttggaaggatagatgtagagctaaccaatattaatggaaagtcaatagccaaaataacagtcccatcaagtttggataggattgaaacctctatattagctgccactttagaaacaattgatagagtaggaccatgtgtagcaacagttaaagtaatagatattgaggacattaggaaaaagaagagagaatacatagttgaaagagctaaggaaatattgaagcagttgatgagcaacatagatgtgaatacaattattgaagaagtcaaagaaagtgtaagaatgggagaaattattgaatatggccctgagagattgccagcaggtcctgcagtagatagttcagacgatattatagttgttgagggaagggcagatgttttaaacttattgaggtgtggcattaagaatgtgatagctgttgaaggaacctctgtccctaaaactatcatagagcttagtaagaaaaagatagtaactgtctttacagatggagatagaggaggagaactgattttaaaagagttactacaagtttgtgatgttgattttgtggcaagagctccaccaggaaaggaagttgaagagttatctaaaaaagaaattatgaaatgtttaagaagtaaaatccctgctgagcatatattggctcaaatattaaaggataaacaaaaaattgatgaaaaagtatgtaaagatgaaattagaaatatggggattcaaacaataccagaaataaaacctgaaataagtataacatctaatgatgatgtggaagtttcaagtgttgagtgtaatccatctaataatgaagaactaccacctaaatataacaaataccgaaagttttatgaaaaacttattgaattagaagattctaaagtgttaattattaatggggataaagaggaaattgttagtattgaggagttaattaataatacagataactataaatctattgacgcaattataattaatgggacagttactcaaaaacttatagacatcttatatgaaaagacaaatttaattttctgtaaagatgcaaaaatcataaaaaagccagttaatttaacactcatcactttcggtgatttaaatgcataaagatgagctgattcaattacaccaactccttatctatttaagaaaatatatcgaaaaaaaatataattgcgacaataacgaatttaaagagtatgatgagttaaatatctatccccatcatattcacagaacaaaggcagagcatatatataccatctttttactttcaagtattatagcaaaaattttatctgataatgggaaaatcccaagaagcgtatcaaacttacttagagtcagtggagaaaaaataaaaaaagaaattcaacgaaagagatgcaaaataaaaaatacaaatacatgaatataataattacgtgagaagatgataatgtttgcattaccaaataaagggaggatttcagagccagtaatgaaagttttagagaaggcaggattaaagattacagttaagggaagaagtttatttgctaacactgtagatgacaacatcaaagtaatgtttgcaagagcaagagatattccggagtttgtggctgatggtgttgcagatataggagtaactggctatgatttagttttagagagaaatgttgaagataaagttgatttcctattagattttggttttggatttgcaaaactggttttagccgctccagagagctcaaatataaacagcatagacgatataaaagaagggatgagagtagcaacagaattcccaaacctaacaaaaaaatactttgaaaaattaaataagaaagttgagattattgaacttagtggagcaacagagatagctccattcataggaatagctgatttaattagtgatttaacatctacaggaacaactttaaggttgaataggttaaaagttatagatgaaattgtctcatcaactacaagattaatagcaaacaaaaacagcttaaaagataaagagaaaagagaaaaaataaatcaaatagttattgccataaaaagtgttttatttgctgaaacaaaaagattaattatgatgaatgccccaaaggataaagtcgaagagattagaaaattaattccaggaatggctggtccaacagtttctaaggttttatctgacgataatatggtagctattcatgccgttgttaatgaggatgagatatttaccttagttcctaagcttcatgctttaggagcgagagatatattggtggtgcctattgagaggattttataaacttacccaaaagttttatatactaaaagtcaatatgttgttatacctattctaagccacgatgataactacagggcttttgcaggaaaatatttcttatataaaaatatgcaccttatagatgcaaaattccttataaatatcaacaagtgcaaaagccctgtaggagtgggcaattccctccggattgcccattttttagcaaagagatgaaggaggttgaaagacatggcagtttatgtaaaatttaaagttccagaagaaattcaaaaagagctattagatgcagttgcaaaagcacaaaaaatcaaaaaaggagctaacgaagttacaaaggcagttgaaagaggtatcgcaaaattagttatcattgctgaagatgttaaaccagaagaagttgttgctcacctcccatacttatgtgaagagaaaggaattccttacgcttacgtagcttcaaagcaggatttaggtaaggctgctggattggaagttgctgcatcatcagttgctatcatcaacgaaggagatgctgaagagttaaaggtattaattgaaaaggtaaatgttttgaagcagtaaattattagaacgctatttaaccatcaatcaatagtatatagttattattatataaattatgaaacactactactaacttttttataaattttaaaccttcattaatattaggtgatgaggatggaagatgaatttgtttataaggaagcagtagctgctgaagttattgaagtcattggtagaacaggggttactggaggaattatacaagttagatgtaaaatcttaggtggaaaagatactggaagagttttagttagaaacgttaaaggtccagttaaagttggagacattattatgttaagagaaacagagagagaagcaagaccattagacagaagaagataaataatttaatcttaaattattttaaaatcactgaaacactattaaagggggatagctatgccagaatggagaacatgcagcttttgtggttatgaaattgagccaggaaaaggaaaaatggtcgtagaaaaagatgggactgtattatatttctgctcatccaaatgtgagaaaagctacagaatgggaagaaatccaagaaaattaaaatggactaaagtctatcaagatatgaaggcagagttaaagaaagctcaagaatcacaataagttatttggcttttttggtatttaatttaaatttttaaatttattttattttttaaataaccttttattttggtgataatgttgaaatttattgatttattttgtggatgtgggggattttcaagagggttcgtggaagagggttttgagccattggtagctatagagttaaatgaagatgccgctttttcttatgcattaaattttaatggtcaaatatatgaaaaaataagacctggagaattcaaattgaaagaattaaagggctatgttggaatctacccattcaaatttccttttgaagaggaagatataaagtggctaaaaagactgggaacactaaatgaaaaaaccaaaaaattaagtcctgttgttattaatgatgatattagagaaattcatgcaattgagatagaaaagttcatcaaaaataaaaaagtagatgttattattggcggtcctccctgtgaaggttatacaggagctaatccaaagagagagaaaaatccttatgatagattgtataaagacgaaactggaagattagttttagaatatataaggattgttggagatttacaaccaaaaatatttgttatggaaaatgttcctggtattaaagaagttagaggggcaataataaaagagtttagagaaattggttatgaggacgtttatttcaacactttaagagctgaagattacggaaatccatctgttagaagaagagtttttgtttcaaacatagaaattaacccagaaaaaactcagccaaaaactgttattgaggcaataggagatttaatgtataaaggtagagatgtcccaaatcatgaattcgccgctctacctgcaaggtttaggaagagagtccataaattaggttggggagatgcatttatctatttcaaaggagccaatagaaggttggggaattatataaggttgcatccacttaaattagctgagacagttatgggtaagaggttctttatccacccttatgaagatagattattgacaccaagagaacaggcaaggttgatgagttatcctgattaccatctattcgctggaggtataagaagctgttataatcagattggggaaagtgttcctgtggctttaagtagagctatagccagggtgattaaagaaaacttaaaataaaaaaatgaaaaataaataaaaaaatacaaaaaactaaaaaggtgagaaaaatgtttatttgtttgcataacacatacagtgctaagcaagtagaagagtttggaagaatcgcttatggatttgatatcaacacaatagttgtaacaaaggcaactgcatcagctgctcagagtggaattccaacactacataaaatggcatacaaattaggaaagaatgttttattctttgaagagttagatgatgctatagaagttttaagacctgagaaagtgtttttaattggaaataaaagtatctgtgatgagaaggtagattttaatgaagttggagaaaatgatttggttgttttctgtggagcttcaaccggtttcacaaaattagagttagagaaaggtttagggagatatatagtagaaaatgagattggagctttaggtaatttagctatcttcttatatgagatgagcaaaaaaatctaaaaaaattatttattattttttattgctcttttggcttcatatttttgatgatttcaataaatctaccaattactttatctcttaacccctcaacaaacttcaagctacctgcacactcatgacctcctccatccaaagatgcctcaggaatctcctccattaattgctcaactattaagtttaagttgaaattgtatttttcatgaactgcatctgtagctctaacaactccaaagtcagggccataggagagagttatgattggcttatcctcaccatatttttgaactatatagtcatgagcaaatccagttgtttttcctggagctgggaaggtaaatttgtgggcatatttctcaacatctaatgtatttaatataattccattctctaagaattctgtttttaaagctggaattactgccttcatctgtctttcaaccatcttcattgcctgctcatacaatatgtctataagttcttcatgtcttccaaactcttttatgtttgttgctaatatatcatcaacaattcccttaccatccatgaatcttaagtagaacgcctcaaaatccatacatagggctattttctccaaatactctctatcgtaagttcttcctttaccgtattttttactcaattcattcaatctgtcaagggctatttttacatactgttccgcttcctctcctttagcatggtctccaacaactgctattcctggaatatgctttatctcatcctcaacatctggattaatcatcctcgctatttcagttcctaatactccagcggttaaattgctatctcctccaactaagtatggattgacatgagcatctacgtagtcatcaacctcaacttttccatcaacaacctctccagggaagtggtggtctattacaataacctctataccataagctttagctttggatatggctggaatatcttcatcagtacttccattatcaatcaatacaatcaaaggtagtttctgaccaaatttcaaggcatcttctatagagaataccaaatcctttgttacatcttctaattcatagaatggtgcttttgacggcctccttttaaagaagtgccatattgcatcaacgtctatggcaaatttatcaattattggtaatattgccttttctaaagcaattcctccacaataaccatctgtatctgcatgatgtctaataattattggtcttccgtctaaaactgccttcctaattctcttagcaacatccgccatttttggtctcaatctctctaaaacttcactcttaactaagaatggaatatccttagctggctctgcccttctatcaatttcttcctctatttttttcctaatttcctctgcctcatctccttccaatttttgaagctttatcctttcaatctgtaatcttccatcccttattgttactctaccaataacatcaactatgtctccaactttaacatccggatgagctctcaaaccggctatttctaaagcagctacccatgcaaagtcagttccatctgttatggtgaatactgtaggtcctggtgtctgaacaatctgaacaacctctcctcttatatgcacaacctggtctctcatctcaactaaattttgggatatgtcctttatctgagacaatggaacttctttttcatatttaactaaatcataggttgttagtgggatgtatttaaagtcaatctctctcttttctggtcttacatctattgcttgaactatgatttcatcaccaacatttaaattctccaatcttaagcttatcatgtctcttggtcttaaaagccctctaacttgttcatttaaattgataaaagctccatacttctcaattcttgtaactactcctttgtaaaatttacctggctcaacatcatagaatgttgccaattcatcaaacacatatacatttctaagccctttctttctctcttcctcttcttttagacatttatcacacaatgtcctatctttaaagtcaggatatttaccaattatagctccgcatctatcacatttaactacctttccacttccaccacaaaaatcacattttgcataaactggaacttttcctgtccctttacatttagggcagggaatttctccataatctaagtcataagttgctctcttagaaactcttttcatgtgttgctttggtgaaaattcatctataaatccagttccctcacatacagggcatgttttgtatttaactactttctttcctgttccatcacaaattggacactttactatcatgttctcccccagataattgtaaaaaagaccttggctttaaattactaacatttatttaagttaatataatggatgatatttttatatgatttattatatagaaaatagacagcaaatagttatttaaaaataaaatatcaattgttatttatatagtttttcatgcatgtgataaaaacaataagaagaatatttagtatagctataaaaaatttttaatggaactttggctgtaatgagcatcttattggcaatggtaaaggcctatatgggtagttagcagtttcttttttaatcctttcaatcaactcatctaatgtcatcttctccttatatggtttctttaaggttgatttttctctaatagtaactgtcaatttgtcagattccatttcctcatctccaataactacaacgtaaggaacccattcttttcctgcatttctaatctttttgcttacactttcttctctatcatcaaaatctgccctaatgttgttttctctcaacttctcagctacttttaaagcatagtcataatgtctttcagccactggaataactctaacttgtatcggagagagccaaacaggcaacattggagcatttcctttttcagcctctatagcagctttttccaacaaaccacacaaaaccctctcaattgaaccagttggtgagcagtgcaatattattggataaatctctccttcatttgtatgcacttttatatcaaatctcttagcactctcaacatctatttgcacggttgggttctcaataggtcttcctaagctgtctattacagcaatatctaccttaccaacccaatagtgttttctttttggtaaaatctctaaaattacatctttcccatatttgttcttatattcctttgctattttaaagaaccaatccctatgctcatcaaagaagtcctttgtgaatctaaatattactgaatagcttagatttaaatcatccccagtttttaaacattcccagaactgtttttcaaactcttccattgcttgctctaagtttaagcagacagtatgcatatcaggcattgtaaagcatctcaatctctttaaaccaaccaactcccccctctgctcatatctaaagctgtatgttgataattcatagagttttaatggcaaatatcttggcaatagatacatatcctttttcatcataaactgcccaaagcatgctgcaaatcttagcattagctctttatttccttgtctaaacctatactgcctctctccaaatttatcagcatgttccctaatagcagggtttcctaaatcatacataattggtgtttctactggcatagctcccatattgacaactaagttataaacataatcagctaacaaatctctcatcaacttgccctttggataccatctgaaatgtccagggtctgatgcttcctcataactgcagatatccttttctttaataaactttacatgaggaggttcatcatgttctttatgctctctaattcccaattcatgtttagctaaagctaacaactcttcatctttaattatatttatgttgttttcattcaattcaataatttcctctgtttctgggtttaataagtagaattttgattcttctccttcttctttcttttcttccttagctacaatctttcttgacaactcactcaaaggatgtcctttacagctgattttaaatgccttataccatccaaatggtgctcttaagacattataacctctctcttttaaaatactctcaatgtcttttaaaaccttaactgctgtttctggtgaggataaatcacttgatagatgtgcataaggataaacaacaatattattgacctttaattgattagcaactttctcaatctcttcaactgctcctattgcagttccttctggattgttttcatcttctctttcaactgcaataaagcaggctaaacactcatccaacttaccttttaagttttctgtttcctctgcaatcttggttttttctttagcttcaaactctaagtaatcagaatggattagtagcatcttcatattatccctcaattaaattttagataaagataattataaaagaaaaagatatattaaatatttttgctttgtttaatcaatttataagggtgtagttatggggcatctaacactcaaagatgcggtatttttaacgataacgtccattgttggtggagggatttttgttctatctccattaacctatttgctgtttggaaaatctataatatggggttgggctttactaatatttgtgtctctaattatggcttctccttttgcctatgcttccactaaaataagtgagagtggaggggtttataaatttgtaatgaaaattttagggagagaaattggagttttttcagcctatatattatggctctctggagtttttgctctatctggagttgtgtcattctttgaaatagtttttaatacaaaatttaacgtttcttatgttggattatgtttgattgttattttaacagctttaatattgggagggttgaggattgtgggaaactttgtcagaatctttggaattttaacgataacgattattttatatatcgtattttcaaatggaataaaaattgacagcattggagagtttaatttaaaaaatgctattttgacaatatattttggattatggactgctactggttgggaaggtataacaatgccattgtcagcatttaaaaatcaaaaagctatagcttatggactcttggtagggacttttatcattggagttttgtatctcctgttttccttgaccatagtatctttaaatgtaaaaacaaacaacttagatgagatattaaagatactgattggagataacctatttttattggctgggatgttattaataatttccagctgtgcgtttagtgttttatttactttatcatatatgccttatgggatgggaaaagataggatattcccaaaggcatttataaaattaaggaaggagattccatactatggagttattttaaatactttattagttataatcctattaatttttgatgcaaagactttggtggatatgagtatgttttctacattaatagcctattttctgctatatttggcagtgtttaaagaatcttcaggtaaaataaaagctatatcattaatctctatgctgataactggattgttgatattatttagggtttataactttattattctttagttgatgaattaaatgaactttaatctatcattttgaaaggttaagttatagcgttttaatgatatatctgattaggtaaaatttttataacatcccatcataaataacagaaaattaaaaagttttggtgggattatgataatttatagggaagagaatgaaattataaaaaaggcacttgagaatttaaacattccagatagggtttatatctttgacacaacactcagagatggagagcaaactccaggtgtctctttaactccagaggagaaaatagacatagccataaaattagatgatttaggagttgatgttattgaggctggttttccagtatcatcattaggagagcaggaggctattaaaaaaatctgctcattaaacttagatgctgaaatctgcggattggcaagggctgtaaaaaaggatatagatgtagctatagattgcggagttgatagaatccatacatttatagcaacctctccattgcatagaaaatataaattaaaaaaatcaaaggaagagattattgatattgcagttgatgccatagagtacataaaagaacatgggattagagttgagttttcagcagaagatgcaacaagaacagagattgactatttaatagaagtttataaaaaggcagtagatgctggagcagatataatcaacgttccagataccgttggagttatgattccaagggctatgtattatctaataaatgagctaaagaaggaaataaaagtccctatatctgtgcattgccacaacgactttggtttagctgttgcaaactcattggcagcagttgaagcaggagcagagcaagtacattgtacaataaacggcttaggagagagaggaggaaatgcagcattggaagaggtagttatgagcttaatgtcaatctatggagttaaaactaatataaaaacacaaaaactttatgagatatctcagcttgtatcaaaatacactgaaattaaagtccaaccaaacaaggcaattgttggagagaacgctttcgctcatgaaagtggaatacatgcacatggagttttagctcatgctttaacctatgaacctatacccccagagttagttgggcagaagagaaaaataatcttaggtaagcacacaggaacacatgcaattgaggcaaagttaaaagaattaggaattgaggttggtaaggatataaataaagatcaatttgatgagatagttaagagaattaaagctcttggagataaaggaaagagagtcactgacagagatgttgaggcaatagttgaggatgttgttggtaagttggctaaaaaagatagagttgttgagttggagcaaatagcggttatgacaggtaatagagttattccaactgcatcagttgctttaaagattgaagaagagattaagaagagctcagctattggtgttggaccagtagatgcggcagttaaggcaatacaaaaagccattggagagaagattaaacttaaagagtatcatataaatgccataactggaggaactgatgcattggcggaggttattgtaaccttagaaggatatggaagggagataacaacaaaggcagcaagtgaagatatagttagggcttcagttgaggcagttatagatggaatcaacaaaatcttggcaaaaagagaaaaatgatttcatctccttataaattaatataaaaataaaattattttttattttataaaatttaatttatgaattcaaataaactaattaaaatctccaaaataataaaatgttggagggtcccttacgggttcccctccaacatacgacgtgtaacgcaggatgtaggataccccaaagatggttagcgttgcacgcccaccccaatatctcattacatgcaaatctaatatttatacttttcttattagaatttttagagcatctctttaactttcttaatgagtatcttcaatatttctctatctggtaagactccttctggtggatcaataaccttcctcaactgaattggaaccccatccattctataggcagttccttcaacctcaactccagcgattgctggtggaatgatgatgtttgccaattgagttgttggtgtttcgtgtgggtcaatacaaaccaatggtatctttgccatgtgctgtacagctttttgtgggaagtgtgctccaggatctgaagcgatgttcaacatcatatcagtttctcctctttgcaacaagtcgttagctgttgtctctcctgggttgtatcttggataacctcttgagaaatcaacaccaaatggataacctgtaacccatgtcaagacttggttgaatccattgacgttgtagtgtcctctcattggcattaatccgaattttgtgtatgcgtttaagtcaataaccaactggatagcattgtcaatgtttctatgcttacctcttgtcatcgttactcccatagcgaaaaacaactctccaaattgggcatttttacaaacttcaactgcttcatatatcaaatcagctggaactccagcaactttatctacttgtaactcaaagcccttcaacacagccctcattgcactaactaattcataatctttatgtggctctacttgtaaatgaatatctgccaactttgcagtatcagtctctcttgggtcaacaacaatcaaagtcctatcctctcttcccctctctctgaaaaaccctcttgcaaagactgaatatctactcatatgccttgggtgggcgtgcattgggtttgaaccccagaagatgataacatcagctctgtttttaacttctcctaaggtacagacggggtatcctacatcctgcacagctaaaagtgaaggtccgtgtcaaacacttgcagtgttgtcaataactgccccaactaattcagccaactcaaccccgtacatatgtgcatgacattcagtagcactccatccataaattagaggtaaagtagcctcagttaataatcttgctgtttcttcaattgcagtttcataatcaacttttttgaaatcatctttcttgttttctctcattaaaggctctgtatatcttacagctccctcaaagtgcataaacttggcatttccaattctacacgcatgtcttgttccaactatgtggttatcttcaactaaaatctctaagtcatcacataatgtcccacagaacggacagacaacatttctaacaacttttaccataagggattcaccccttttttaatttatcttaactccaaaaccttttttcctttcttttctttttcagctacacttaagcagagtaagcacattacacagtatcctttcaatggtaatttgcctcttgataatcttaatgtcttcattgggcagacttctacacatttgccacacttatcacataagtaagggctgaattcaattctgttgtattccttaccattatgttctatcttaccaagctttaaagctcctgttggacaggctacagtacaagctccacagacgatacacattcttacttccttcttctcctcatcaactacaattgcttcagttggacagactgaagcacattttttcaaaacctcaaagtcctcctcaacaataaccaagccctcatcagttattgggtgtggtgagcttagtttaacctctaaatctaaagcatcgactggacagatattaacacagagcttacaagctgggcatgattttggtggaataacgattaagttttcctcatcaaccttaatcatatctcccggacagacttcaacacactttagacaataaatacacttctctgcattaacttcaaacttcttaacttccttcctcctcttcttaggtattttcccagctacaaatatagcattccatggacatgtttgggcacaaatactgcagtaaatacacttactcttatcgatgactgctttattattctctaaggttattgcattaactggacattcaggaacacaaattccacaaccaacacaagcatcagtaactgctatcggttcttttggtggctttatttccttcttaggcttatcaataactccaggtaatgaaatgatctctattggacacacgtcaatacacttttgacagaggacacaatgcccctttgagtaagggaaatcatcatcaaccttttttatgccaataggacaagcctcagcacactgcccacatttctcacacttatgagctaaataattaaccctcttcaacttcttcccattaacttcaatctcctcctccaccaaagctcccgttgggcagactttaacacactccatgcataagttgcatactttaaaactatctatatctattgctttggtaggacactccgcctgacacgcataacagactaaacaagcatctttttgaattgttatgctcattaatctcatcctcctaaaaattatacgctaaaatcccaaaaaaggattttagcgaattccccctgcatagagggagagagctcacaacctcccaaatgggttcggttgtgagcttattctttaataacctcaataattttgtttcctttttcatctttaactattatgtgggcggcacatgagtatcaagggtcgtaagctcttaataccatttctattaagtttaattttacttcatcaactttaactgtgcttttctcagccatgtttatcaccataaccataaatgattagataatcataattgattttctttacaaaaatttatttatttgaagattacttgagctgcctgttggatagccttttccattgttggaacgttgtgtgttgtagcgacaatcatgtttgccttaacaacgattccattctcatctgtttcatagttgtgaattaaaactcctcttggagcataaactactccaacaccatttccagcctttggttcaacatctgccttaatgtcatctgatgtaatatcattatcttccaataatatttttgccttttcacatgcttcaactaactcaatcaaccttgcatgattatatgccaatgactgatttgctggaaatccaaagatctctaaaaattcttttctgtattcttctgcaagcggggtctccatttcatcacaaacgtttagcatcgctaatggcccaaccctataaactccttcaggataaccgacttttttgtagtaagggtgttttacatagttgtatggaactacatattccccaatatagttcaagtattcttccggtttaaactcaactttttcttttccatctggagataagaatcttaaggtatcgtcatagaagttatgttttccatctttaaccaaacctaaataataggtgtcaataactcctaatgtctttatctgttccatatattgctcatttaattgttttataagctcaacaccatttttagcgtattctatcatctggtcagcatcttttaataactcatctctttcttcttcagttaatctctttgcttgcccaccaggaattccagtaactggatgaatagcttttcctccaactgcttcaacaatcttttgcccaaactttcttaaggcgatagcttgcttagcaacgtctggagctttatctataactcccacaatgtttcttattgctgggtctgcatctggaccaagaacaaagtcaggagctgctaagaagtaaaagtgcaatgcatggctatgaatcatatttcctatgtgcattaactctctcaatttcttagctggttctggaatctctacaccccaagcggcatcaattgccttaacacttgctaagtggtgggctgtttggcagataccacagattcttgggacaattcttggaacttcttcagcaggtcttccaacaacgaactgctcaaatcctctcaatgcagttatatgcaacttaacatccttaggttttccattttcatctaaggttattgtaactttaccatgcccttctaatcttgataggggctcaattactatcttccccataaattcacccttattttattatttatgcttaatttattttgcctttctgttgattaaagcatctggtagtgtgaatctgttcaataaagctaccttatctggaatctccaaagctgcctctccagcgttagccaatacattagctgcgttagctcctaagtctaatgatttatctgttttaccgaaacaacctctacatggaactcctgcacttggacattttgctccacaacctgctcttgtagcaaatcctaagcaagtgtatccttgctcaaataagcatctttctgggtctggtcttccttcatgggttcttttaaatgtttctggaaatacattctctttttttcttggacattcatcacatacgatctttgttggtaattttggttcttctccatttagtagtgctataattgcatctgcgatcatttttggtgttggaggacatcctggtattgtataatctacttttatgaagtcctttattggtttaacatactcttcaagtggtggaatttcttctgaaggtatttctcctttattttctgttgagtcggttgagtagacataatttagtaattcttcttttttgtatagatttcctaaacctggaatccctccataagcggcacaagttccccatgcaatgacaatctttgatttctctcttatttcatgaattaagtgctcatcgtgctcattcctaattcctccctcaactaaaaatacatctataccctcaggaatctccttagggtctgcaattataggggcataaacaatctctaaatttggtaaaacttccaataacttgtcatgtaagtctaatagggatatgtggcatccagaacatccacacagttgtatcatccctaccttaactgccaaggtaatcaccctaaaaagtttaaattagttttgcaatgccggagaaccccttacttatggggcggttgttctctcggtcccttgacgggttcccgagagaactcatccctttaatctccggctttactgagctttgagagggttaggtccgagtttttcaactcttgcagtcatttcattaacggcggagacgaatttatctgcctcagcggcagacatgaaaaacatgtcaattctgtctccgccaattcctaattcatctaataattgtttagcgaacctaaccctctcctcagcctttaagttacctgtttcgtaggcacactctcctttctttcaccctacaaccataaccgcatcggctcccttttggaaagcccttaaagcgtaggtaatatcgaatttaccggtacaagggagccttacgattcttacggttgcagggtattgcattctacttgtccctgccaagtcagcagccccatatcctcactgatagcaacaaaatgcaattattactggatccatactaatccccctatatattattaattttataaactcgataacaacatgagaattaaatttataatttaatttggatgagggcacttaccctctccatcagcaccactttggcattgccttcgagtggtgcctcatctggttttgtctgcccccaatgttgagctcataacctacgccgttatatttttgagatttttattagaatgtagagcttgtgctttttaattattttttaactttctaatttttggtgagcttctaatactccatcaatgaatgaaattatttgctcatctctatagtatctcaactgcattgctccacttggacatgctccagcacatgaaccgcatcccttacatgcaacgtcattgacttgagctactaagtgtccatctttttcaacataggttatagcattgtatggacacatcttagcacaaacttggcatcctccacagacatcttcatcaacaactgcccttatcatctctattctaaactgtccttgtgccattggtattgaaacagcacttgcggcccctttagcctgagctacggtatctggaatgtcttttggtccctgagcaactcctgcaattgctataccatcgacctttgtattaactggagctaactttggatgcaactccttgaagaatccatctggactgagctctaaaccaagcatcttagccaattttggattgtctggtcttggtgacaatcctgctgacaatacaactaaatctgcttcaatttctacaatctctcccaataatgtatcttctactctaacaatcaagttctttgtctctggatcttccattatgcaagctggccttcctctaatgaacttaactccaaactgctcctgagctcttctgtaatactcttcgtaacctttaccaaaagacctgatatccatgtagcagatataaacttcagtgcttgggtcgtgctgtttaattaattgagcattcttcaaagcaaacatacaacagattcttgaacagtagtgctttccaacctttgcatctcttgaaccaacacactgtatgaatacaactctgtgtgggtgctttccatcacttggtcttatttcatgccctcctgttggtcctgctgggttaatcattctttctaattctaatgttgttatgacgttgtcatagactccataaccatactcttctttcaatgtagcatcaaattcatcataaccaactgcacagatgattgttccaacctttaacttaatctcttcaggtttttggtcgtatcttatagctcctggaccacaagctttttcacataagccacatcttatacagtggtccatatcgattgtatagacaagaggaactgcctgtgcgaatgggacatagatggcttttcttgttcctaaacctaagtcaaattcgtttggcacttcaattggacatacagcagcacaggctccacatccggtacagatgttttcatcaacgtatcttggttttttctctattgtgacttcaaagtttccaataaatccttcgacatttttaacttcagcataggtgatgagttcaacattggggtggtttgcaacgctaaccatctttggggccaaaattcacagcgcacagtcatcagttgggaatgtcttagcaagctgagccatcctacctccaattgatggctccttctcaactaaataaactttataaccttggtctcctaagtcaagagctgcctgaattccagcgatacctcctccaatgattaagcaagatttatcaacttctacaattttttgtggaacgtcttctaatctcttagctctttcaacagcccctgcaactaactccattgcttttttagttgctttttctctatcattcatatgaacaaatgaacagtgctccctaatattgacaaactccaagtaatatggagataaacctgcttcttttatacaatttctaaaagtaggctcgtgaatttttggtgtgcatgccgcgacaacgactctatcaagattatattcctttattgcttctttaatcaagttttgtcctgggtcagcacacataaaaggataggtctttgctacaacaactccgtctaatttttcagcaaaatctcttactgcttcacaatcaacaacaccgttgatgttcgctccacagtaacagacaaataccccaactcttggggacatagattcacctccaagaatagaaatcacaatcaattaattaggaggataactataaaaatatatattcttaaactggctaatggaagttattaaacaatctaatagtcatatttaatttaagaacgctttaatttaattaaaattttttgtatcgaaaagtttatataggtaaagtttgtaataacaagttggcgcgggtgggatagtggtgagccccccacctcaccgctgataacccgcgccataaggagccggctccagtagattaacaaaatttacagttaaacacccctcccccacacagattttttatttactatttttattgataaatttaaatatatggattaaatataattatatgtccataaggtttaaataaatcaaaataacaacaaactaataattggaataaaattctaaaaatttctataataaaatttagaaattaaaatactgctaaaaactgaggggttaaaatgaaaaaacttgagtattatttaaaagatgcattttattatgtgctttcagatgttaaaaaaggaatagtcggaggattgttatcatcaacctctggagctattggagcaatatttggaattatcttgtctattctattaatacacaatattaatcctaatgatgttgttggattggacaataatattttattaacctctctaattgttgcaagttttgggtttttaattgcgttaattataggtttcatacttgatggttactatgttagagtaatgaaaactactgttgaaaattatgatgtcctccctgattgggatgatattgctgagttacttaaaagaggttttttatactggattgggaatattatactctcaataatctttatgattgttccaattttgtttattatatttggagtatttttaatatttttgcctttagtgggaattgtttttataggaattggatttttacttttgtttgtatcgacaattgcacttttgatatatgaaggattagcagaggtgaattactctgtaaaaggattttctggattttttgagtttaaagaaatatttagaatgataaatttaaattatataatattgcttataattgttggagttatagtcatagtgataaattttgttgtgcaacttccatttattttattaaaaatctttgctatatctccagcaagatattctactttctcctcttcagagacgattgttgatgtgatatcagcagtaatttctgcctttgttggattctacacagcagtattcgcaaaaagggctattgcgttatattataaagatagagttgaagaattgaaaaaataaaaactaaaaaataaaataaatggagatttattcagtagctaagtgatacaatctctcagcaagttcaaaaataacttctttattttttaaaccatcaatccactcttttggaatatttttaaagccgtagtatgctccagccatagccccatacatagatgctaagctatcagtatctcctccagcatttatacattttaacatgccttctttaaaattatcagttagtaagtaggttgctattgctgaagggacaacttcatcagtttttacgccagttccaaaataatcatagatataatctaagttattaaagtttttaatttctaatagttttttagcaaattcctcatctatgtcttttatgtagttgtagcattcatctaacaagctaaaatcttttctgtcttttaatgcactactaacaaagaatgctatagctaaagctccggcaattgctgttttgttgttatgagttatttttgatgcctttataacttcctcttttagtttttttagattattatgaaatacaattcctaatgggtagattctcattgccgctccacagctactgctatctactccagagtagtcattattttctaatttatcaatagccattaatgaggttaaaccaatatctggtggattcttgtttttccatgctattaagcaattggcaaatttttttatatcaattccttctttggttagagattttattaaacagatagcttgctctgtatcatctgtccattctcctttgtttagcttcccagctaagtagttttttggttcaacataggaatctacaaatccatacagcttttttatctcttcctttgttagattttcagttggcattcctaaagcatctccaataactgccccaaagacagaacctaaaattttatctctcatttttaccataaactcatcaccaactaaaatcaataaatactttttaaaagataataaaatatttaaaaaattatgtaatggtggcatgatgaagataggtgtctcaacgttatttttttgggagtatccaatggttgagatttttgacatatttagggatattggaattaaatgtatggaattttttccagagaatccagatttttgggataataggtttgatttagattatatcgctgatttaagaaaagaatttttaaagtttgatgttgctttacataatccccatattgagctaaacccatcatccctaaacccttacgttagagaggccgttataaaagaaactttatggagcattgaactggctaaattttatagatgtaaattaataaccatacacccaggaaaaagaccaacaaacaggtctccaacagatgaagaatatgaagcattttttaaatatttggatagaacattagaagtggctattaacaaaaatataacaatatgtgttgaaaatatgccagaaagaattaacagaattggttggagtccagaggagatggaatggattctaaaaagatatgatgaattgttgtatatgactttggattttgcacatgctaaagagtatatggaagagtttttggagagcgttattgattatattaaacacactcacatatctggagttgttaatagaaaagaccactttccattaagaaaatcagaaattgacttctctccttacataaaagctcttttagattatgggtataacggaatgtttaacttagagcttgatgatagaagattagaaaaaaatccggtaacaaaagaggaaaaaatagaagaggtaataaaggatattgaatttttagagagtattatttaattatttctctattttaaccaaatcctttaactcttctggaacatttccataagcaactgctggaattattgctggctgtccattgttctctaaaacttctggatgccctaacacaaatttaacaaactctatggcttcttttttatgtggtgcatttgttggaactgtcataccataaacaattggttttgcatttattgttttattctttgcaattatttttaaagccacttttttgtaagtgtctgcatattcgtaatatcctaaattaatttcctttggaagttctatatattttaagtggtgttggtttgcaacactcttgtagataaagaggtaatcaaacgctccagcttctaatggagctaataaatctgtctccttacttctaacaaacaatttgttagtatctacatctaactctttagggactaatatcaagtatgttccgttattttcttcaacttttatgtttgaatgctttaaaactaagttgtcatagattgttgggtctttataatagagttctgctaactgcaggaccatttgggttctgtaaccacacgggtcatcgttagggtttgagaatccaattttaacatctggtctctgtaaaatcttataccaattggttgagtttatttcgtctttatatttacttttatctgtataagccaaaacaatctcatttcttgcaaacataacataccaatctgcatacttaggcatcatcatttgagggattaaagaataatcagctgaagctaagatatctgccttttttcctaagtcaattatctttcttacacatgcaacacttccagctggttctctttcaacatcaacatttggatgttctttttcaaacatcttttcatactcttcaaaaggcacagataaacttccagcgtggaatatctttaaaacaatcttttcctgggcttcagagttttgctgtccgacattttcctgttccatacaaccacataggactgttccaactattagcaatattgagatgactattaatctttttatcatctatattcaccttttttaatagattttcaaaaagtaaagataattgatttcatatttaaatattatattcatcaatagtgattaacaaaatctataaaatatcaaaaatccaaaaataaaaattaacataataaaatcaaaaaaataatggttgggggattatgaaaaatgctttaataaatgcaacgacaaaaaaatttgaaatcattgagaaaactgttttaccaataacttggggattgtattggcataataaatttgaaacatggaagtacgatgcctatgatgaaaaaaacgttttttgctttggtagtggagttttaccagttataggaggacataggttgatattttcttttaggtctcctctctgggatggtttttatttttcatcgatgggaggggcaggatatcaattcaaaagcactggattaaacaatgtggcaattattggaagatgtgaaaatccatccatattggtaattgaaaacgatggacaattgagaatagattttattgaggttaaagaggaacttaaaaccgtttatgaagttagcaaatatattcttgaattatacaaagacaaaaatttgaggagtgttgttgttggtgaagcggcaaagagaacaaatatgggaggtttattttctcaaacagttagaaatggtaaatttgttgagggttcagaggattgggcagcgagggggggaggaggttctgttctctatagagcccataacataatgggaatagtgttttttggagatgaaaaggaagataaagaggaaaaagagaaagctaaaaagattattgaaagctattacaaaaaaccaatgagtaaggttgttttagagcatacaaaaaagtataggtatgatgaagaaacaaaaactggaggaacgtttggaaacaattggcttttgtataaagagaaagtgccaatatttaattggagaatgccatatatagataaagaggatagaaaaaagattttagaaaaaatacttaaattttatcttgaaatatttaataaagaaactattgagccaaaaagatgggctaattgtggagaaccatgtcctgttttatgtaaaaagtatagaaataaaaacaaagtggattatgagccgtatgcatcaaatggaactttattgggaatatttgatttatatgaagcggatagggttgttaaaacagctgatgcattggggtttgatgcaatagagattggaaatctaactgcttgggtttttgagcttttagatgttggtttgttgaaggaggaggagctaaatataaaaaagccaatatttgactataaaaaaataactaatgacgatgatgaagagattagagaaatatcaaaacataatgccgaacaagctataaagtttatgcataacttagcagagaactcaaatgatttatataaaattttatcattgggaaagagaaaggcagctaagatattaaatgagagatttaaaagtagagttaataagattggcaaaaaatttaatgactttgcagtttatgttccatttggggattggggagagatagccccaaatctctattggactcctggattttttatgccatttgttattcagggaagatatttaacttactacaaaccagaatttaatgagccagaaaaattagctgagttggttgtagaaagtataaaattagaattaccaatagaaaaccttggtatttgtagattccacagaaagtggttaaaaccagtattaaaagaactggttaaagaacttttaggtatagaagatattgtagaggattcaataaatctttatagagagatttgcgaatataacaaaaaaattggatatcctgcaaaaattgagagtgagagggttaaagatttgattattgcaatggctaaggagtttggtaatgaggaatggactaaaaaatttgaaaataaagaaaatgtagatgagtatgtaaaaagagttttaaataaatactctgagttattgggtattgattggagaattagttaattactcccttgcaggtccagcatcttcaaacccctgccttaaacctttaccagccattcttgttaaatattctggtttaaataataaataatagacattttcagcatgttcttcagctcttcttttggctaaccaatctaactctttatcatcctttgcctcatcctcatgaacaaatacttcaattatatgcttatttgtcattaattgagccaacattaagccaagagatgcctcatgagcgcagactttgtctttctctgcctttccaggcattcctaaggccataactatatcacagccctcctcttctaacagctttttacatgctacaggtaaatcttttattcctggaacagtttttctaataattttaatatttggagaaagttcttttaacttttttatagctatggaagccatatccacccttgcaaatgttgtatctacaattcccaccttttttgtcaaattttcaccttattaatctttaatctttacaatatatgcttactttaataaaaccgtccattagatagtcaaagtcaatttctttatcccaccctgctttttggaaaatactcataaagcaaactccaataacttttttaggggatagtttatttattagttccttaattttatctacttctactccatactttggcattgccaaaccaccaaataaaacaattgcatctactttatttaagttttcaaaatcttccatctgcatgcctatatctttaataacaagttttttaactttgtttaaatctccatctgggataaagtaacattctttatctcgtattgcataaccaaataattcagcaaagggttggcagacaccaacagaaccgacaaatgcaaccttctctatattactatctcttactaaagttctaaactctcttagcattggagaaagcccattttcttcttttaatagttttaatgtcatgatatcacccaattagtagagagatttaaggataattttcatagattcatgagctggaatgttatagtaatctcttagtagttttgtaatccttaacacattaaaatttctcacagctttcttttctttatctaattcagcaaatttttttgggatatagtctttgtattttaatactgcttcattcaggtcatatttttttataaatcttgataagatatacgcagaaataattgcatatatattcccatgtcctaaaggtgttgttaaacctatactttctccaacgcctgcaacacacctcttctcgtatattcctccaataaaactctcagaaattaaatttccatttatttttgatgtacatccacagactctaacgtaatcactaccaaacatttttttagtgtattttgtgaggtatgtccataactcatggtcgtttttatagtatgcacatccaacatgatatagtccatcgtctataggagttatccaagtataaccaatcataggttttcctttatgtatctttatttcatcaataaagaatttatcaaatttttctggagattcttcattttcataggctattaaaaattgacaggttttaatatcatttttatatttatcatacacattgcctaattgaagtactttagcacatccagaagcatcaacgaccaaatcataaaatttagtttcagcttcagtattaaattctctcactataactccagtatcaataacttttgttgtatacctccttatgactggattaaattctctatttgtaactactgttcttggaaccaagtcttcaattagtttggatttatttatgacataaatttttttattaggatagtagttatctccaccaatatttacttcctttatctctctaattatataatctttaatgtttatatttaccgtttttaaaactttttttactgttaaaatctcatttttattggaaaatataaaattcatacttttgcagcctctaactaatacatggtcataaatatttatgtaaaaaccgtcttccgaaagtaatctgtacaatatagatcctgacaatcccgctccaataatacatacttgcataaatcacacccttaaaccaatacaacagatttaaaattaagatttcatatattttactataataaaaataaatcatttcaaaaattgacatatgaattaaatatcaaaataacaaatagttatatttataaatttctatgaaaatatttataagtcagaagttataagatattataatattattaagttcttttatctatatatgcgcatcctagataagggtgagaaaatagagggtttcaaaatgttttttatattaaaaattttttaagaattttcataaatagtttaggacttccacagtttatatatttgactgtttaaaaagaataactctaaaatccattatatcagcaataaattcattcttaaagtcctatagtaaaaaagattaaaaaatagaggattagttatttattatctcattgtaagtttgcaggtcaaagattatgtccttgacttcttctgatgatgcatcttttagctttccatttattaatccttggagcttcattgcttcaacgaattttatgactttaggtattactggttctaatctataatcaaactttatatgctcaattgaatctttctcaacattttcgtttgttccaagccatctaacagatgctttaacagctaaatctctgtttttgttaatttcatctgtcgcatcctttaagagttttgcaaatgttataactgcttctcttttgttttttaaggcattttcagacgctgctaaacaacagcatggatggtttgcccaagttcctcctgtagcgcttggtaaatcttcactgtgggcaataacttttccaatacccttattttttataatttcaggcattggctcccatgcaataactgcatccaactgcttttgagctaacatttgaggcattgtcccctgtcccttacaatttactaacaaaaccatagcactcttgttattagggtcttcagtataggttatcccttctgcttttaaagcatcttctatcataacgtattgaattgatgttggtagtggatgtcctattttaacctgctttccttctttatgttgttcttttatccaattaacaaactctttccagttatttactggaatatcctttctaacaacaactgcagaacttcggtatgcaaattcattatgaccttagcctttgttcccttatctatgtagaatattactggtgggtatcctaataaagcaacatcaacctgtccctgagtcattaggttcattatacttgctccaccttcagtaactttaacaactttcacattagctatttttttatttcctttatacaactcatattcctctttatctttaactgctttcaagcatattccatatttatctttaaataaatctggattgtcacaggctacaaatagggaagcatgatggtctgttggcaaatatgcaactgtcaaagttggaacttctgaagtttcattttgaacacatccagcaaatagtaccaaagatgagattagcaaagccaccaacatataaatctttttcataataccacctcaaaattagtcaatcatcaaaacttcactaattaaattggaacaaataaaaccccaaaggggttttaaataccctttgttgaacaatttttattttgatgattgactatatgaacataagtatgaacataagaaaattttgactatgcaatatataaaattttttatttttttatagataatttatcttataagaaaataataataggataagaaaataaattataaaaattttaataaaaaagcattagattttaatctctttattgcagaatctcctaattatctcttttacaatatcaaaagagctgtgaaatggacattttttataacctctaaatctaacaatctctggatataaattatatttagcaagttctttttttagtgtttcctcatcaaaagttgtctggtcaggaccaagaacaataatatctggttttaactctaatattggctctaatttatttttcaaacttcccaatattgctttatcaacaggctttaatgcttcaaccatctccctcctttgttcttccggaattataggttttctaccttttaatttctttacagtttcatccctcgcaacaataactattagctcatctcctaaacttttagcaaattttaatatctcataatgtccagggtgaagaatatcaaacgttccagcggtaactaccctctttttcataactattcacaccatttctttttaataggacattaattgcccttgaaaagggcaacttataaccaattatcaaagttttaaattaatatggcacttatagaagccttttgggcttctaaatattccttaatagatgatttaactttgataattagctaatggacatggggtatccacaccatagaggggcttcgcccctctattgggatactccccaaatcttactaatttacacctccgagcgtaagcgaggagatgttaggttttggtgaagcttttactaaaaggttcatcccaataggggtttccccctatggatgtcgaatgttccggcagttactactcttacttttttcataattatcctcttagatttttttatccctatattttgccaaataaaaggcgtttaaagccccaacgactaatggaccaatagcaaatccactgagtcctaatgaaaggggcgccattaaaaacgcaataactacaaggactgggtgaatatctacttcttttttaactaaataaggtcttataacaaaatctggagctatggaaaggaagagttccccataaataaacataaaaactgccttagtatagtcatgtattaaaaagaaatatatagctattgagatatacaccatccatcctcccaatattggtaataaagcaaatattccggttattatcgcaaataactctgcataaggaaccccaagtataagatatccgatgtaggataggatagttataattatagaaagtgaaacacagcttataaataaatttttgtaggagtcatgaagataacttaaataaattctcatcttttctttatattcatcaggcacaaatgaaattatcaggtttttggctttatccccatctcttagaaagtagaatgttaagaacaaaaccataattactttaactattaaatatccaacatcaataatctttccagaaaactgactaaccaaatattttataaattcgtcaatatactttgcaattatttgttcattattaataattctttctaacataaaagaattatatatggagaggatttcattaatatatggctctatagatttagtattgaaagatagtatgatttccatgaacgttagtagggcgtaaattgtaattgtcataattggaaggatatatatgctaattgccaaacctgctgatatggttttattaaatttttttcttaatatgttatagactggcaaagccatatatgcaaaggcacatgaataagctaagacatcaataaacggccaaattatatataacaacattattaacaatccaacaataactcctttcctaacgtatttgaattcctcaaatctcatagtatcacgtgataattatgaaagttttaatgccaagtatatactatccttatattgggggaatcaccttacatgtagaaaatttggtaaagcgtttaaaagatattgagtttcatatattaacctatgatagttatgaagaaaacgaatataaaaatgtaattattcataacgtccctcacctaaaaaaatttaggggaattagttatcttataaatgcctataaaataggaaaaaatatcattgagagtgaaggtattgatttaattcattcccattatgcgtttccacagggttgtgttggggctttattaaaaaataaactatctattccacatatattaactcttcacggaagtgatgctttaatattaaaaaactccataaaggggagatatttttttaaatatgccacaactaattccgataaaatcatctgtgtaagtaaatatataaaaaatcaattagatgagaatttaaaaaatagggctattgttatatacaacggagtaaataaagaaattctatacaatgagggagattataactttggattgtttgttggagcttttgttccacaaaaaggagtcgatattttaatagatgcaataaaagatatagattttaattttaaactcataggggatgggaagttatacaaaaaaatagagaactttgttgttaaaaataatttaagccatattgaactcttaggaagaaaaagttttgatgaagtagcttcatttatgaggaagtgtagttttttagtagttccttcaagaagtgaaggttttggaatggtggctgttgaaggaatggcttgctctaagcctgtaatagccacaagggttggggggttgggggagattgttattgatggatataacggactattggctgagaaaaataacccaaatgatttaaaagaaaaaattctggagttaataaataatgaagaactaagaaaaactttgggggaaaatggaaaagaattttcaaaaaaattttcttgggaaaaatgtgtaatgggtgttagaaaagtgtatgaagagctaagcgattagacataaaatttaaatataagaatttttattataattccatatggtatataaatgataatccataataaaataaaatgattataatattcccttcacttaacttaaatttaccggtgatattatggtttttgaagaatttatttcaactgaattgaagaaagaaaagaaagcatttactgaagaatttaaagaagaaaaggaaataaacgataattctaacttaaaaaatgatttacttaaagaggaactccaagaaaaggcaagaattgcagaattagaaagtagaatcctaaaattagaattagagaaaaaagagcttgaaagagagaatttacagttaatgaaagaaaatgagattttaagaagagaattagatagaatgagagtccctccattgatagttggaactgtagttgataaagtaggagagagaaaagtagttgtcaaaagctcaacaggcccaagtttcttagttaatgtctctcactttgtaaatccagatgatttagcccctggaaagagagtctgtttaaatcagcaaacattaacagttgttgatgtattgccagaaaataaagactacagagctaaagcaatggaagttgatgaaagaccaaatgttagatatgaagatattggtggattagagaaacaaatgcaagaaattagagaagttgttgaactcccattgaaacatccagaattgtttgaaaaggttggaattgaaccaccaaaaggtattctgctttacggaccaccaggaactggaaagacattattagctaaagctgttgctacagaaacaaatgctacctttataagagttgttggttctgaattggttaagaagtttattggagagggggcttcgttagttaaagatatattcaaattggctaaagaaaaagctccttcaatcatattcatagatgagattgatgctattgcagcaaagagaacagacgctttaactggtggagatagggaagttcagagaacattaatgcagttgttggcagagatggatggattcgatgcaaggggagatgttaagataattggggccacaaacagacctgacattttagaccctgcaatattaagacctggaagatttgatagaatcatagaagtcccagctcctgatgagaagggtagattggagatattgaagattcatacaagaaagatgaatttagcggaagatgtcaatttagaagaaatagctaagatgactgaaggatgtgtaggggctgagttaaaggcaatctgcacagaggcagggatgaatgcaattagggagttaagggactatgtaacaatggatgactttagaaaggcagttgagaagattatggagaaaaagaaagttaaagttaaggaaccagcacacttggatgttctctacagataaaccttttttattttttgactattttaatttttattttaaatgtaaaactaagcaattaaaaatttttggtgacattaatgaacacctatggggatatgtttagagttacagtttttggagaaagtcatggaaaggctgttggagcagttgttgatggatgtccagctaatctgcctttatctgaagaggatatccaaaaagagcttgacaggagaagaccagggcagagcatcttctcaacaccaagaaaagaagaggataaagttgaaatcttatcaggaatttttgaggggaaaactactggagctcctatttgctcaatagtctataacaaaaacatgagacctaaagattactcaaaaattaaagatacaccaagacctggacatgcagatttaacctatagattgaagtataaaaactatgattataggggaggaggaagggcaagtggtagagtaacgatagggcatgttattggaggagctattgctaaaaagcttctatcttacacatacaacataaaaattattggttataccataaagattggaaagattgaaggagatttcagctactataaaaatccagaggtttttgaaaatgaaaaatccttagagagattaatagagattattgaaagtaatccattgagatgtccatcaatgaatgagaaagagatggaggagtatgttttaaaggcaatggaaaataaagatagtgttggaggagttgttgaaattgttgcattaaatgttcctgttggagttggaaatccaatattcaataagttaaatggagaattggcaagagctttaatgagtataaatgctgttaaaggagttgagataggggctggttttaaagcggctgagatgtatggaagtgagatgaacgatgagatgtattttgatgacgacaaaaatataagattcaaaacaaacaactgcggtggcatattgggaggaattagctgtggaactccaatagttttaagaattgcagtaaagccaacaccttcaataggtaaaaagcaaaaaaccataaatttaaaaaccttagaaaatgttgaaattgaaattgaaggaagacacgacccagttatagttccaaggattgttccagtggctgaagcaatggttgctataaccttagctgatttgatgattaagggaggatttattcatccgtgtagcttataaaatttttatattttttattttattatctatattattattattttgtttttatttatcttaatttggtttatttaaaagaaatgggtgaaaataatgaagtttatatttatcactggaggagttatatcatcattaggtaaaggaattacagcagcttcgttagggagattattgaaagcaagaggattcaaagttaatatgattaagatagacccttatctgcagatagatgcaggaacaatgtctccttatgagcatggagaggtttttgttacagaggatggtggagagtcagatttagatttggggcattatgagaggtttattgatgagaatttaaccaaaaacaacaacataacaacaggaaagatatattggagtgtcttaacaaaggagaggaagggagagtatttaggaaagacagttcaagttatccctcacataacaaatgagataaaggattggattaaaaaccttggagaggggtatgatataactatcgttgaaattggaggaactgttggagatattgaaagcttacctttcttagaagctataaggcagtttaaaaaggatgtgggtaaagaaaacgttttatacatccatgtttctcttttaccttatataagagctgccggagagttgaagacaaaacctactcaacatagtgttaaagagctaagaagcatcggaattcaaccagatatattaatttgtagaacggaaatgccaataagtgataaaattagggagaaattagccctattctgtgatgttgataaagaggcggttattgaggcaagagatgcaagaacaatatatgaagtccctcttaatttagaaaaagaaggtttagggaaattagttaccaaaaagttaaatcttccagatagagaaccagatttagacgaatggagaaagtttgttgatagggttataaacccattaaatgaagtaactattggtatagttgggaagtatgttgagctaaaagatgcttatttaagtattacagaggcattaatccatgctggagctaaaaatgacactaaagttaatataaactggatacattctgaaagattagaaagtgaagaatttgaagaattattagataggtatagagaagataatcaattagatggtatcttagttccaggaggatttggagatagaggagttgaaggtaaaataaacgctataaaatatgcaagagaaaacgacattcctttcttaggtatatgcatgggaatgcagtgtgcagttatagagtttgcaaggaacgtttgtggcttagagggagcgaattcaacagagtttgatgaaaacactaagtatccagttgttgatttactgccagagcagaaggagattgatgcaaaaggaggaactatgagattaggagcttatccagcgatattgatggagggaactttagcttataagttgtatggaagaaaggaagtttatgagagacatagacataggtatgaggttaatccggaatatcatgagatattagaaaatcatggcttaacaatttctggaaaatctccagatggaagattggcagagtttatagaaatcagcaaaaatagatacttcatagcaacacaggcacatccagagtttaaatcaagacctaacaaaccacatccattgtttgatgggttagtaagggcttctttgggagagaagattaaataaacttaagagttaatctttaaatagctttttctttttataaatgttgtcatgatggtcaaaatcaacgaaaataactgttttattattctcatcaacggtgaaaacaagaacaaagcttttatcgatatgaactcttttaaaatcatttaaaggatgtcttaggtttttataatggtgtggattttgagtaatctcttccattttctttaatattgcttttaatttctttttgtctctctttgaaagtttttgaagtattttatccaatgaaggcattatttcgatttcatacatttattcacctaaatatctcttttttagattttcaatagagccaatgtatataggtttttcatttttcataatgtttctaattttttcaatatattctggttttagttcgtcctctaacagaaattctgcatattcttctattattttgtttatagcctggcttttatctcttaaattgtattttgctttgactatatttattattctgttattttcatcagtaatatcaactattgctttaaccattaaaatcaccttattaatgtggcattaatgtgatattaatattatacaaatatttgtataaatagttttatgcttcgataataaaaaagaatttctattgagattttatgaaactttgtagaaaaataagaaatatgtttttcaaaattaaattaaatctggattgctatcaactgaaatatataactgcccttttggtttattatagacataatctccactaaacttatagaaggttcctgctattggtgttccagcgtcttttttacttaattttataactggattctccacaataccctcaaacttgaatgaaggtaaaatctcttcaacctttccatagacaactatagctcctgccttcatctctcctccaactctcacatcaacatctccatcaataataattattcctccattttgatgaattccagccattattccaacatttccttttatatgtatgagacctttactcataaactctccaatctcatttccagcgtttccttcaacaataattgttcctccactcatacctctccagtctcccctatacgcagaaccaacgtaatctcctgcatttcctttgattaaaagctctcctcctttcatattctgtccagcccagctctcagcatttccattaacaactatctttcctcccttcatctctgccccaacatacattccagcatctccttcaacaacaatctctccctttgtcatctttgaaccaatgtattttaattttggacttgagtttttaattacaattcttggttctccttcaatatcatttaattcaacatcaaagatgtcagcaactttaattctttttcttccttggactaactcaatgttttttatttcctctaagctcatgttctcaataacttctggcaatactttatccatctctactggaacaataatttccttttgtaatgttagaattaactccttcataccatcaccggcttattattttttatcagtcaattttctcaactataacagccgttccatatgcatagtaggttaattctggaactgcatagttttcatcagatatgatttcagttgttaattcattagagattcttattccaataactgcattagctcccatatcttcagctacatctattaaatcttctaaggcatcgtctgggtcatcaccatagccgattacaacacccaaatattttacaattttaaaaccttctaagttgtcagttgtggaagttatcatcaaaatcacttaaaaattaaattttagaaagaaaaggatatttagtttatatcagttgcatctatctttataactctccagctgtttgcatattcatctgaaactgggtagttctctaagttaactgagtagtatcttctaaacttctccccaacatctttaaggacttcattcattaagtcctctcccacctgcacatctacatagattgtgtctccaaagacttctttaacaacgtttccatccttaacaactacttctcctcccttcaatacatacttagcatatctaaatgccttttcaatcttcttaccatctttctcttctgggtctattgcatatattgctatgtcagcctcagctccaactcctaagtgtccttttgtctcactcaatcctaaaaccttagcttggttagctcttgttatttttgctatttcatataagtcgtattctttatcagcatccgctacatggcttctttgctgtgcccacttatgaactttgttgtataaccattcatccctatacttcttactcattaaccatgcaataactcttggatatcttgtgaaaggccctgcgtttggatggtcggttgttaataataccttatctgtgtttgtatttaggaagagttctaaaccaattgcccattggacagcataaactggaccttttgggctgtaaatgaaaggaactactccagaacctgtctcaagctcaacatcacagtttgcccacttcaatccattagtcatgtgtaaatcatactccattggtccatctgcagtcattgttgttgtttcatctaaggtaacttgtccaacatcaataacaacgtgttttgatttatttacatattcagctatctctattgccttactttcaaagtccttccatgaagtccctccataggagtgaaattggcaatgtgtgttgtagtatgatgtttccctctctccaactcttggttttgcctcaacgccttcaacacacttcattgtctctaatgttgtctcccagtttcctggatgtcctaagttgtttggatggacgtggattgagtgaggcaaaccaagtaactcattaacctctgctaaacctctaacaatctctcttggtgttatatcaaagtatggaactgggtcatctaagctatgaacgtttttaccccaaccccaagcttctgttcctcctggattaactatctttatagcaaatcctttaacagcctttaacagccatgcaacaaaagcagcacatgccttaatgtctccttcttttaaatactctaagaccatccagttgtttccaaacaatggcattgctgccttgtctatttgtggagtctccataaattcctcatgtgtgtgtcttgcaatcaatgggggcattgctgcctcaatgacagttgtataacccatttctgaatattgataacctgttttataggttgatggaactgaaaatcctgttccagttcttaatccttttttagcatagatttctcttttactatcttctggtctgaatattcttccgacgttaacctttgcccctgcaacgtggctgtgtgaatcgattccaccaggcattactacgcatccagatgcatcaataacttttgcattatcagagacgctctcaactatctttccatctttaacacatatatccattttttctccattaatcccatttaatgggtcataaacaattccattttttatgatatattccatcttatcaccatttattaatatttggtttattcaacagcttcaatgtatttttttctcattaaagacctcatatctaaaaattcttcgtctgtcttctcaacttcaacgtaaaagccaggatatcctttaaatgtcggcattccagtgctgtgtgtgtctggtttaacaacacagtttgcccaaggtcccattgggatgtaaatcattccttctggcattctttcagttgctttttttacataaactacaacttctccatattctgacttaactttaactttatctccttctttaactcctaatttctccatatcttcttcgttgatataaactactccagcagctttaacatacaaatcaaggttttttccagcctccattgcctccccttgccaaatagttctgcctgtgtttaagaaaaacttcattatctcaccaatttagcttattttcttttaaaaactaactctatagcattaactgggcatgcttctatgcaagctccacatccaccacataaatcttgattgactacagtaacaactccattctcaactctaataactacatcatcactgtaaggtccttttcctccccaagtttctggatgtttagcattaactgggcatgagacaacacagtttccacatccgtggcatctttctggataaactaccaactcataagctttcatttcctcaccttttaatgatttttaatattctttaaggtattttcaatttaacccattaactttttaaacgcttctttccatgcaattgcctttggttctctttcaaagttaatttctgttctcttaacttttatagcattaactggacatgctttagcacaagctccacacaacacacagaggttttgatttacaatgattcttggaactttttctgccttgtcttttggttttgggaattctaatgcactacatggacatatggaaatacaggctccacaagcgttacatgcatttacatcgattattaactctcctttgaatggcttctcaacttcaatagcttcagctggacagataaaggcacaccatccacaggttacacatgcatctttatcaataactgtttttcctgtaatatcctcatacaacttagcttgtggaattctcttcatcattggacacttgtaacagataacctcaatagcatcatgcggacagacgaattcacaaaccttacagaagacacacttatccttatcaacttcaatatcagttattggttttgggtttgatggagttgggtagttgtattttaaattaatagcatcagctggacagtattcagcacagattccacatagaacacatttctctttgtttatgtttatctctccgataacaaacttctccctctctgccaattctctttcaacaactatagccccttgaggacaaaccatttcacactgctcacataaaacacacttgtcttgataaactttaatatctctcttaatttttggatatctctcatcttcttttattgatttaccattgattttcaaatccaatgcatcaaatggacatgctgaagcacacattccacataaaacacagacatctttatcaatatccaattttggagctattatgtctcctttagcaatagctcctaaaggacccatagcaatggcattaactgggcagatatctgcacagataccacatccaacacatagttcatcgttccaacagagttctcttttttctacttcaccatctctatatatggtaaatccattttcatagacctcttttatttgctcaatcatggttattcctccttaatgaattttaatgagtttgttggacatctaaatatgcaagatgcacatagatggcaggtatcttcgtctataccaacagtgaagttatcaagtgtgagtgctgcacaccctaaacaggaaccgcaagctatgcaggaattttcatcccagaaaagttttataccatataattctttaattaagttctttgcaagctctttattatcagttaaagaatgaataaactttgctccatattgtggtggcatttcttcaataatttttgcaacatttaagattttttcctttggatacctcccagagagataatgagaaacgattgacctatcgctcttaataatttttgctatttccttctgcaaaagcccttttcttcttaatttcattgccactattgcctttattccggagagaatatgctctggcatcgtctcacatggacattatgttagttgatgattttcatttataaatactatgtatgaagtttaagtagaaacttttttatataggtgtgtgtcttgctcacatatttataaatagttcaacatatatgaataaaagttctatttttggtagaaaagctttatattggtaaagctaataatataaaaatacaaccataaaaaataaatattataatgatttagattagaagaatttacggtgatgattatgagagagattctaatatccgaatgtatagaattattaagatcacataaattcatcgtctcaaaaccactgggaagaagttgctttgatatggtagcaagtaaagaggatattagattaattttaaaaattttaaagaatatagacagtttaagtagagatcaatcaaaagaattaaagaagattagcaaaatactgcatgggactcctttaataataggcattagaacaagaaacgcccctatggagcatggagttgtttatgacagatataatataaaagcagtgacttttgaaacgttcagagattatttagaaggaagcccaccaatggtttatgcaaatagaggaggattttttgtaaagatagatgggaaggtgttgaaagaagttagagaggctatgggtatctcagtaggaaagttggcagaagttgctggtgtttcaagaaaggcaatctataaatatgaaactcagatggcaaatccttcagtagatgtggctttaaaaattgaggagttcttagatgtgccgttagttaaaggtattgatttatttgagcctgttgatgatgaggatgttgaaaataaattagaaaatttagaagattttaagaaagaggcgataaattttctaaacgaattaggatttaaatcatttgttgttgaaaaggctccatttgatgcagtagctgagaaggatatggataacaatctaaatattctattaacaaatattgaagaaaaagataatgaagaagtaaagagaaaggcgttattcgtgagagaattgtcaaggttattagatggatattcactattaatattggaagaaaaagagaaagagtataaaaacttgccagttgttagtattgaagagttaaaaaagatggatgatgcccttgagttgattgagcatataaaatccatgttaagagatataagataaatttaaaaaattgatgatttaaaaagtaaattacggaaattttttgtacatttgttttctatgtaaaactctataaaacacgattttttcattttcatatttaaaaccaattctataatcttcaatttatatgctgtctctaaataaacccctcatctcttccattgcctttaaaagcccataatctaataacaactcttcaatctttttaaatgtcttataacccaaaataactcctttaatatttcccttttcatcggtaatgtaggattggacaataattcataataaccactaatattacgttttaatagtaaaaaagttaaaaaagataacgggatttataattccaatggttctccaatctttggaactatgacctcaactcctaaagcctctgcttttttcacaaactcatttacatccacttcaattaacgggaatgtattataatgcattggaataacaatctctggatatattagctcaatagccactaatgcctcatcaattcccattgtgtatcttccaccaattggcaataaagctatttgtggagcgtaaatctctccaattaactccatatctccaaataagccagtatctcctgcatgatatactctatcatttataataaatccagcagcaactcccccacttattgttggagagatatctgatgagtgctcagctttaaccattgttaattttgctccatttatctctatagtccccccaatgttcattccttctgcacaaactcctctttctgataaatagacactaatctcatggttcgttactactggaacattgtaggttttagctaactcttcagcatttcctaagtggtctgcatggccatgagttactgctattacctcaactccttccattatttcatcataaggcaaatcacataaaggatttggaacaaatgggtctattaacacattatctactttaaagcatgcatgaccataccatgttatcatcctctcacctccacataataattttaatgttaagctatttaatttttattatgtggggaaattttctcaatctgataaaagtggtttatggatgtttaaaaattaaactaaaaatttcaaaagcttaaaaaaataaaataaaatggtgaaatatatgaaaatagtgggaattactgatttacatggaaaattacctccagcagttagagaatttaaagattttgctgatgttttagttgtttgtggggatataacacactttggtaaaggaattgaggttatagagaaattggctgagttatcagattatatggaagttctatgcgttccaggaaattgtgatactaaagaagttattgatgagttgaatagctttaaattaaatatagatagaaaagtgaaaaaaatagagaatataaattttgttggaataggagggagtaataagaccccttttaacactccaaatgaatacaccgaagaagaaatatacaataagctcataaatgtggttaaaaacttaaaaaatatatttttagttagccatgcccctccatataacacaatggctgatattgttgatttagacaaagatatccacgttggaagtaaaagcattagaaagataattgaagattttaatgaaaatataagattctgtgcctgtgggcatatacatgaaagtaggtgtatagataaaattggaaatacaatagttgtgaatccatctccaaagagttattttgtctatgacactaaaaagaatatggttgttttagatgattttaatggattttaaaatttttgaggtaaatacatttccattttttaattgcaaaactttttatacttattaaagaatttaaaataaaaaacacaaggtcactactttaaaaagttgtgatagttatggatgagaggaaacaattattgtttaatgcaatatttgacatatataaaatctttcttggtgctggattgatattgttagttgcagttattgttaaagttgccttctccgaaggtagttttaatactggtttaacactatgtttaattgacatcatagcaatgttttatctaagttggctatttgggagtatcttgtatgacatttacaaagaattataagttaatccttttgatggattagctttcttccaaatttccaataccatatagccaataatgttgagaatacaaccataaagccaattactaataacactaatatagcaaaggcgtcaaatttcatgaccatcaactccttatttttaatctaattagacccaaaatattaactctttttgtaagaatataaaattatcatataatgatttttttataaaacttatcataaaaaggttttcctttagacttataaggttatagagttattttgtttatgatacaaaaaagaatatggttgttttagaagatttcgctggattttaaaataaaaaattaagtttttgattttctatatatgatataggtaaagaaagcagttatggctaaataaacgcttaatggaattggggcttttgttgatgatgaggatgttgtagttgtatttgaggttgtatttgaaggtggtgggaaatcgtaatgaatgacgtcaacaatacatgcgatatctccactttgttgataagaaccccaatttaattccccagaaacattaaaaataaagtgattattactctgatgtactttatacaccatacctggataatttggattgtaatgtatatctatagtaaatccgtttataacttgatagtcactaaaagcttcatcttttgggaatattttttgataaagtatctccccactactaatattctttacagttatttctatggcattatagtcctctgcaaaaacattttgacacaaaaacatggctgacaaaattaatactaagtatattaacagtttattaatactacgtatattatctctcatattttcaccagtagatatacaatatcatgaaaataaaatttatttaattaattgctcatttaaaaatgttttcatttgaatttagaacttaatttaatatattaaaataataaaaattcatcaaaaaattaaaaatagtattaatatggaaatattactccattgccttctcaaatgcaatcattgcacttagaactttttcatcttcaaatggctttccttggatttgcaaaccaacaggaattccatttatatccccacatggaacaactccagcacacaaaccgcagatattagctgggactgttaaaacatcataactatacatctccattggtgttaatttttcacctaatttgtgtggtaacttaggaactgttgctcccactataatatcaacatccttcataatcttaatcatctcatttctcattaaattccttgcctttaaagcgtttttgtagtatttaccactatactctttctgactaatcattgaaccaatcataattcttcttaaaacttcctctccacaaacttcctctattttatatccatatcttcttccatcgtatcttcttgtggatgagaagaactcaacgtagttgattaaatagtaagttggcaatgctaaatcaacatatttatagcttaattcaacaatctcacaacctaaatctttaaagacttcaatggctttttctaccttatcccttatcttctcatcggcaacatccataaactccttaacaactccaaccttaaagcctttaatatctttcttttcaaaaggttttgtctctaccgttgttgtgtcccttaaatctttacctttaatgatatttgttaataataatgcatcttcagctgtttttgttaaaggtcctatttggtcaaaactcattgccaaatcacagaggccatatctgctaacaactccataacttggcttaaatccaacaactccgcaatgtgaagcagggttcctaatacttccccctgtgtcactacctaaagccatatcacataaatctgcagatactgcagcagcacttcctgaagaacttcctccaggaattctatctttagcccttgggttttttgttggtccaaaataagaggtttctccactactaccacatgcaaactcatccatatttgctattcctattatcaatccaccattttctttaatcttctctataacagtggcatcgtaaggggctatgtagttttctaaagtctttgatgcacatgagattgtatagccctcaacgtttatgtttgctttaactacaataatctttccatataatggctttttcttagctttttcatctttttctaatttttttgcctcttctaaaactttttctggttttacctcaattagagcattaatatccttgttgattttttctattctgtccaaatactcttcaactctctcaacaatcatctcatcaccgtaaatttttttggttataatattgacttatatttatttattttttgttattccatttcctccaatattcttatttctttctcaacatctacatcattaactcttctaacaaccataattaattcatcattctctactctaacatttccatacaaaacaaactcttcccctaatatttcatcttccaccatttctatagttaggttctttaactcctccctattcatttttaacatcttctcaactcttctatcataagccctacataataaagttccagtcccatcatctacaacaaaattcaatcttaaaatctcttctggctcaacatctccacaaatagggcagttataaattccatcaatctctacaaccctctttctacaatttgggcataaataaagaaagagagtgtcactcaatatcttaactacagcccctctaacttcaacagtttctccgtcttcaatatctgctataaactttctattggtttttatttcaaccccttctggatttataattattcttccatattttccaataaccaaatctatataatctcccctctccttagcataggcatgtaaaatttctacaatatctccttctttaatctctatttcagccaaatcatcccataaactcaaccttattcttccagttccatcttctaacaataaatttcttacttttctaaccttatcttcaaattcaatttcattaactccataatcctcaacaacttgagctattaaatttatatcgttccagtcaacatctctattataaatatcttcaattttgcaatattttagctcatactctggagcttcaatgttttcatctttaataacttctgtttctaatgtggcaactaaatcagttcttttatttccttctctatcataaaacgtcttaactctacagtttgttattctaactaagtccccttcttttatattttccaataaagcagtttttcctctccaaaatgaaactctaactctaccagtgccgttatctaatataatatcttgaacctttgctatctctccatccaaatctacgctttttttattacttatggctataactctacctttaacactcaccagttctccatcttcatattttgttaaatcctcaatatttacttcttcactctctattttttctcctttttttaatatctctacataatttgcggtgcattctaaacccccataataaccttcccttatatagcccctaactctaacgtaatctcctctaccaacatcgatatctgttagattatcccataaggtaactcttatacttcctgtctcatctctaacaataaatgattttaattttccaatactaccatcagctcttttaaattctttgattggaagagctgagataacttctccttcaaatgttgctgtcattccaggacttagctcaccaatattgtaggtatctttaatctctggaagttctccttcatagttttctaattttttaatcttagtttcagatgttgaactcaactctaaattatttctccattttcttgctcttgctctttcaattttaataacatctccaacttttacatctaattcagccaaatcgtcccataaagtcattcttatagttcctgacttatccgctattgtaattcttttgtatttccctaaactcccatctctccttttgaatgtttttatttcagagatatcagttataactccagttatctcaacgcctatctgtccctcttcaatatcactaattaaaaattcttcatcatttttttcttctccataaactccatgttcttttgcaatcatcattaatgcagcatctttcaatattattcctccgttttcttcaatttttttatcaatcatcctatctaattcctcctcactaatattcaatgcttcagcaaccttttttttgagttgtttaaatctttcataatctcctatcataaatcatcaccataaaaaattattttgaatagaattctatttaatttccttcaattttatgagccatgaacataccttgcaaatatttccactacatggaaaaccacatatctcacatctcctgatttcttctttaacatttaaatattttaaaagtttctcataacctctcaatatactaaacttaactcccggcttttcttcttccaaaatctcaattacttttttcattctatgtctataagatagagacgagtatggacatggctctctctgatactttatattatttatttcagcatataacttaacttcctcttcaggaattaactttagtggtttgattctcttaacaaaccctcctccttcaaattctttaccaaactgaataatattttttatatttccctcaacatagttcattaaaattgtctggcagaaatcatccaaattatgccctatagccaaataatcacagccttcttttaaagcatgtttatttaataaatatcttctaactactccacaaaaggaacatggtttccctatatttaatttgcttaaataatcattttttacaatttcatctaaggtataaccaatctcatcctcaaattttataatctttaaatctaaattatattctttacaaaattctttaacgtatttttctgctatgttcctaaaaccttttattccttcatccacaaaaaaacaaattaacttagcgtttggaatatgtttaaaaagctcctttaaaatatatgccataactaagctatcttttcctccactaattccaatgcctatttttacattgtttcttataatatctttccctaaaacctttttagctctcctttcaatatcttttttaaaacattctttacatagatgcctatttgagtacttttgataataaaatgcttcgtttccacagctacatagcataatttccctcaaattaaatatatgattatataaatggcaaattaaaaaataatatataatataacataacataaattttttaatgtataagttatgtggggaatccaacattttggtgattttatggaaaaatgggagttaaaaaaattagcagtatgttttaattgtaaaaaggaggcagaccagataattgagatttacacaaatcaggcatttgttaaatgtagcaactgtggagctacaagatattacatattaagaagggtggggattgaagatgaaagtataattgaagatgaaaaaaataagaagcataagtatgaaccatggttcttagagaaaactgctgtgtgctttaactgtaaaaaagaggctacacaagatattgcaataactgagacgaaaatgattgttagatgtagaaattgcggatttacaagggtttatcagttccatatattagatattccagaaaataaatgattgtgtataattatttcacaaatatgaacaaaaccgaaaggtttatatagaacttcaacggtatattatctccagtgagaaaattattataaaaagataaaataaacggagggatttttatggttaaagaattaaaagttgctgaagcatatcaaggagatgtagggaggggtattgcaagaatagacccctacacaatggaagaacttggtttaaaaccaggagatgttattgaaattgaaggtccaaaaggaaaagcttatgccatagtttatagaggtttcttagaagatgctggaaaaggaattataagaattgacggttatttaaggcagaatgctggagtagctattggagatagagtaaaagttaagagagtagagattaaagaagctaaaaaggttgttttagcaccaactcaaccaattagattcggcccaggatttgaggactttgttaaaaggaagatattgggacaagtgttaagtaaaggttcaaaagttactattggagttttaggaactgctttaacatttgttgttgttagtacaacaccagctggacctgttagagtaactgacttcacacacgttgagttaaaagaagagccagtcagtgaaatcaaagaaaccaaagttccagatgttacctatgaagatattggtggtttaaaagaagaggttaagaaagttagagagatgatagaacttccaatgagacatccagagttatttgaaaaattaggaattgagccacctaaaggagttttattagttggaccaccaggaactggtaagacattattggctaaagcagttgctaacgaagctggagcaaacttctatgtaattaacggtccagaaataatgagtaagtatgttggagaaacagaggagaatttaagaaagatatttgaagaagctgaagagaatgctccaagtataatattcattgatgaaattgacgctatagctccaaagagagacgaagctacaggagaagtagagagaagattagttgctcagctcttaaccttaatggatggattgaagggaagagggcaagttgtagttattggagctactaacagaccaaacgcattagacccagctttaagaagaccaggaagattcgatagagagattgttattggcgtcccagacagagaaggtagaaaagaaatcttacagatacacacaagaaacatgccattagccgaagatgttgatttagactacttggcagatgtaacacacggatttgttggagctgatttagcagctttatgtaaagaggcagcaatgagagctttaagaagagtattgccaagtattgacttagaggcagaagaaattccaaaagaagttttagataacttaaaagtcacaatggatgacttcaaagaggcattgaaagatgttgagccatcagcaatgagagaagttttagttgaagttccaaatgttaagtgggaagatattggaggattagaagaggttaagcaagaattgagagaagctgttgaatggccattaaaagctaaagaagtatttgagaagataggtgtaagaccaccaaaaggagtgttgttatttggaccaccaggaactggtaagacattattagctaaagctgtagctaacgaaagtggagcaaacttcataagcgttaaagggccagaaatcttcagcaagtgggttggggaatcagagaaggcaataagagagatattcagaaaggcaagacagtcagcaccatgtataatattcttcgatgaaatcgatgctatagcaccaaaaagaggtagagacttgagctcagcagttactgataaagttgtaaatcagctattaactgaattggatggaatggaagagccaaaggatgttgttgttattgcagcaacaaacagaccagatatcattgacccagctttattgagaccgggaagattagatagagtcatattagttccagttccagatgaaaaggcaagattggatatattcaagatacacacaagaagtatgaacttagctgaagatgttaatttagaagaattagctaagaagactgaaggatatacaggagctgacattgaggcattgtgtagagaggcagcaatgttggcagttagagagagtataggaaaaccatgggatattgaagtaaaacttagagagttaattaactacttgcagagcatttcaggaacattcagagctgctgcagtagagttaaacagcgttattaaagctacaaaagagagagaatctgctgaagcaggagagtttagtgagttaaagaatgctattggaaagataattagcgttttatctccagctaaggagaaaattgaagcagtagagaaagaaatcgacaaattccttgaagttataaacaaagaggaattaaaaccatcagagaaagatgaagcacagaagttggcaaaatacttaaaggatatattaggcaagttaaaagaaatgatagacaacatctacgaattagagaacaagttaaataccttaaaagaacaagtttcagctgaagagattgatgagataattaaaacaacacaaaacattatccaaagattcacaacatcattggatgaactcaagaatatattgaaggacattgaaagtataagattgaaagtttcaacaaaagatgttaagattaagaaagaacacttcatgaaagcccttgagaaaattaaaccatctgtaagtaaggaggatatgagagtctatgagaaattagctcaagagtatggaagagctacgtcagttgaaaagaaaaaggaagaaggtaaagaagtgatttaaattccctaaaaatttttcttttttattttttatctactgttatcgctatatttaaatgtattttatgttcgttttacaaaacatcctatctattaggtttagaatttggttcatatttatcatggatttttgggactgcaataggatgtttttgtggggagttgatattagataaaactttattttcctcattaacattttcacttacagtcctattcttattattgcttattccaaatctaaaaggttttgggaagttatctgcaattattggaggatttatagcattaatttttcaatattttggatatccttcattaggaattttgtttgctggaatattgtcaccaattataatattaaaaattaaatcggtgaaataatggataaaaatattttagcaattatttttgtggctgttgggacttatttaataagatacatcccaatacatttacatagcaaaataaagaatatcgacgaaaaggttaaagagataaatgagatactaatatactcttcaacttcagtaatctccgcattatttatcacatcttttataaaatttccaattatctttagtaatgttttaattagcacaatctcactaatatttgcaatagtttcatacaaaaaatggaataacttaggaatatcaattttaattagtgtagttatttactatttagcgtctaaatttttaataagtatttgaagtgatattttatgtttttgccaactactaaagaagagatggatgaatggggatgggaagaattggatattattattgttactggagatgcctacatagaccactatctatttggagcttctgttgttggaaggtatttggtagagcatggttatagagttgggattattgcacaaccagattggaaaaatttagatgatataaagagattaggaaagccaaattacttttttgcagtaactgctgggaatttagatagtatgttagctcactatacaccacaaaagaggttgagggattttgactcaatgtctaatgaagggataagaaagagaccagatagggctacaattgtttatactaatttaataaaaagggctttcaagggagttcctatagctctgggagggattgaagcttctttaagaagattttcccattatgactattgggataataaagttaggaagagtgttttaattgattcaaaggcagatattttaatgtatgggatgggggaaaagagtattttagcaataactaaggcattagaaagtggagagaacataaaagacttagaaataaatggaactgtagttagagttaatgaaagaaagataggggatataaaggagagatatgagacaaaagaactaccttctcatgaagaagttgtaaatagcaaagaaaaatacgctgaaatgcatagaaaattaatgacaatggataaagttatttatcaaaaagttggaaatcaatatttagttcaatttccaccaatttatttaactgaaaaggaaatggatgaaatatatgagatgccttttgagagaagagctcatccctcctattcttatgtcccaggaattgttccagttcaattttcagttgtaacacatagaggttgttttggtggctgttctttctgctcaatactacatcatcaaggtaaggttattcaaaataggagtgaaagaagcatcttaaaagaaattagaaaattattgaatcatgaagattttaaaggcgttattcaagatattggagctccaacagcaaatatgtatagaatgggatgtaaaaaaggtttagcagatagatgtccaaaaaattgcctatatccagagccgtgtgagaatttaatcataaatcataaaccactaattaagctctataggaagattagagatatcgttggagatgatgttagagtttatgttagaagtggggttagatacgatttaataatgtatgatgaggaatatggagaggattatataaaagaactctccaaataccatgtctctggaagattgaaggtagctcctgaacacatctctaaaaaagtttgtaaggctattcaaaaacctgatggaaggttatttaaaaaatttttagagaaatatagagagatagctgaaaaagttggaggaattaaagaagttttgccatattggcttattgcccatccaaactgttctattaaagagatgattgagttggcagaatttatccataaaaataactgctattcaaggcaagttcaggtttttacaccaacacctatgacactatcaacaacaatgtatcacactggcataaatccaataactaatgaaaaagtttatgttccttacacttatagagaaaagaagattcaaaaagctatctgcctatatagggaggaagaaaattgggaaaaggctttagaaggatttaaaatggttggatataagggggttatttataggtggattatggagcagatggaaaagaagaaaaagcagaaaaaagataaaaacaaaaagaataggttaaattaaactttaatttttattttagttttattttcaaaaatggcataaattttaatgtcaattttctttttttaatatagaattttcgcagtttatatatattctatggaggtatttattcctaaaggcatcatatttcctcataaagatttttccataaagtataaatactgttttatataatctttattttcaaatattcatgtctctaaaataaattaagaatgtaatatgattgaaaatctcaaaaaaaagataaaatcaaaagctctgggagagaatgaaggttattagagactctatccacaaagatatatatttagatgaaaaagagctggagattattgatagcgaagaatttcagagattgagaaatataaaacagactggtttaacatacttagtttatccatcagcaaatcatacaaggtttgaacattccttaggaactatgtttattgcctcaaaaatagcagagaagattaatgcagatgttgagcttacaagagtctccgctttattgcatgatattggacatcctccattctctcacacattggaaatttgtggctacagtcatgaagtttttggcagaaagaaaatcaaacatatgaatttagataacttttcaaagagcgaaataattaaaaccttaaataggaaaaatttagagggtaagataatttctggagatgttgatgctgatagaatggattatttattgagggatagctaccacacaggaacagcttatgggatgattgatttaccaagaattctgaggagtataacaacctttgagagttttggaaaagttaagatagggatattaaagaagggaattcaagcaattgaatcgctattagttgcgaggcatcagatgtattcagctgtttatatgcatccaacagttagaatagcggacactatgataaagagggcagtaataaaagaaatacaagaaaaaaatttggatataaaagatttagctaacatggatgatattgcacttgtttcatttttgaggatttctgaaaactatttgatggagagaatagacaggagaaatctctataaaaatctcatcacctatagttactttgatttaaatccaatagaaaaatggatttttgtcaatttagatgaaaaacaaatattatcattagaaagtaggttttatgaggaattcggatgggatatatttatcgatatctatccaattcctaaaatggaagagcataacgtttatataatctcagatgaaggcgttaaaagattggatgaagtttctccattagctcagagcttaaagccctctgagatgagattatggaatatttcaatctatgcaccaaaagaaaaaattaaagagcttagagagaacaatgtaaaggacaggataaataaaatcttaaaagagttagatgttaaggttgaaagcaagttaattgacattttgaaagaatatgggacaattactggaaagagaagatttttagagattgctaaggaaagaggcatttcaccaaaagagttttacaatgaattgcataaattgatattctgcggtttaataaaagagagatttaataggaggacgtatgtttattgtttaaataattttgttaaattataaatagtttataaagttcttcagctaaaagtttgtatttaacatactttttaacttctttttttgaatttttctttatcaacatagtaaggaattctaaatttcatagtgattgtttgtgtagaacctaatatcatcaacatttactctttttattagatttcaaataatccatcaattcctttgtctttatatactcttattgccttttcaatccattctttttcctcttctaatgtcattttttctgctttttgttctgccttaattaaccactttggttttttgtatttgtgttttttcataattttcgcccatttttgttttaatatattttctttcattttatatcatcaaataacactttttcaatacctttctttttcacctcattaaaaaatttatctacatccttaacatattcttcataagttatattttcaatttcgtttttaacttttacaatccaatctggtagaatatcttcctcctctgactcagcttttttacttcctaagtattttttaacaatcctttttacatgttttttcataatcaccactaaaaattatttttctttatttcttttttttgttttctatatttttctccttgctctttcaaccatttaaaatattcccccgtttcaatagccttttctaattctttttctgcctcaatcaaccattttggttttttgtattttttatatttacttttatcagttttatgcacatttaaaacctctcttaatcctcctctatttaacttttcatagatttcctcaaataatttatcaaattcctcatcagccattttttcaattttatcttcaacttcaattaaccattctggttttttaaattttttatttcttttatttcgtggtttcataataatcactaaaatttttaatttttgaacatactactatatagaacttatattttaatatataaatatctttttcaaatcttcattttcaggagtctgattttaacaatatgtatttctatcttaatcccaaaaaacccctaccaattaaatgagatattctcaaacactctggaattttacttttaagcttcgtttttttaataacatttttaacaaattctttgtcagctccaacatactgaacataaatattttccattttctctggctctggaaagctgtttataagctttatcctttcatcagcatcatcaaagtattttttaagggctaagaatatcttctccttgtttggatacttatcaataacgacaataactggtttttcagtctctttattaatttcccataaatcagctatattaaatcctccaaaagttattccagctaaaaaaattacttttatttttttataatgcttttctttaacaatatctattatcttctctgtaacatccattccatccttcttaaattttctaaaataaatgccgtctattattctattccccctcatatacgtgcctattaagatacacactttatctgccttattaaaaggagcgtcatcaaaacctataacctctacttcatccttcataagcaccacaaattttaaatatctctccctatatttttaatgaagtttttatatatataagtgagagcatggctaaaaaatgtttctgtataagcggaaaaatatttgccctaaatttgtttggaaagagatactctaaaaaaatcataaaaaagagagatttaaaaaaatataggctatatcttcatccagcggttgcagttgatggaattattgagaaagataataaaatcctgctaataaaaagaaaaaataatccatttaaaggttgttttgcccttccaggaggttttgtagaatgtggagaaactgttgaagaggcagttgttagagagattaaagaagaaactggtttaataccaaaggtaaaaagcttattgggagtttattcatctccagatagagacccgagagggcacgttatctcaatcgtctttatattggatgttataggtggagagttgaaagcaggagatgatgcaaaagaggctgaattctttgatttaaataatttgcctaaattagcttttgaccatgaaaaaataattaaagattacatgaggtggaaaaatggttaagttttgtccaaaatgtaacaacctaatgctaccaaaggatggaaagttaaaatgtgctgtctgtggttatgaagaagaaacaacagctgaaggaagtaaggagtatgaatacaaggaacacttagagaacaagaaagaaaaaattactgttattgaaagtgagggattagagacattaccaacaacaagaatcgaatgtccaaaatgtgggcataatgaagcttactggtggctacaacaaacaagatgtgctgatgaaccagaaacaagattctataagtgtaagaaatgcggtcatacatggagagagtatgattaatttattttctacttaattttcttctaacagctatatagagattacccaataaaattagagatgtaacccttataattggctctaatatccataatgatttatcttccgttcctatctgtaaaaataaccttataacttcccaaaatgaaatccaccaaaattctattattttaaaaatatcccattccattcctttaaatcttaaaattgatgctaaaattgtaaataatatcatactgcctaatatccatttacctgttttttccattgattctccatagtcagatattgctccataagccccaatgatgaatttttcaaatctgccattggaaaactcttttattaattccatttccattttgtataggttggatgcttcaatgtaggttctgttattctcaatggatattcttagatttctgtattctgcaaggactgatttataattgaattggtctataatatacttataactcaaacctaataattcttttagtttattttctaaatctttatctttattaccactatcttcttttattcttaaaattttatgacttaaaatttcttcttttttaacatcacataatagcacttctctaacatctgtttttaaaaatgatgtttttgataattggaagttttctatcgttgtgtgtttgtttagaaattgagttttaaggaatattgctaaacctttaaaattttctttatctatttttttaaatgatacatcatctctaaatctacaatcagtaaaagacaacaaattaaatgatatatcatcaaaatatacatgagatttaaatgttgaattataaaattctgctatattaaaagttgtgacactaaaataagtatttccttcaaaagttgtacttttaaaatgagattctttattaaaaattgtgccactaaaattaataatattccctttaaaagcggtgacactaaaataagcattttcttcaaaaattgtgtctataaaatcaacatctccattaaaaattgttcttataaaataaacacttcctttaaaagttatgactctaaaataagcatttccattaaaaacggatatcacaatttgatattccatatttacaaaaaatctaaaatcaccattaaattcaacattataaatatcaacttttatatttatattcacaacaatttcatcatcttttttttcaatataacctccttttagttctttatccttaatcatttcataaatattcaaaatatcaacattcccctcaacaacacaatcctttaacttaaaatcctctcccttctccaaacattcaacaaatctatcaataaactccctactgcttataacctccttttccataatcccacattttattattaaaataaacaaattataaaaatatatattgccaaagtaattattattaatcctacaaaaatttcaaatggtgaatctatgccagcaaaagtattgataaatggatatggttcaattgggaagagagtagccgatgcagtttcaatgcaggatgatatggaagttataggagttacaaagacaaagccagattttgaggcaagattagccgttgagaagggctacaagttgtttgtagcaattccagataatgagagggttaaattatttgaagatgcaggaattccagttgaggggactatattggacattatagaagatgctgacatagttgttgatggagctcctaagaagattggaaagcaaaacttagaaaatatctacaaacctcacaaagttaaagctatattgcaagggggagaaaaagcaaaagatgttgaagataacttcaacgctttgtggagctacaacagatgctatggaaaagattatgtaagagttgtttcatgtaacacaacaggtttgtgtaggatattatatgctataaattcaattgcagatataaagaaggcaagaatcgtgttagttagaagagcggcagacccaaatgacgacaaaacagggccagtaaatgctataacaccaaacccagttacagttccttcccatcatggccctgatgttgtttcagttgtcccagagtttgagggaaagattttaacttcagctgttatcgttccaacaacattaatgcatatgcacactttaatggttgaagttgatggagatgttagcagagatgatattttagaagctatcaaaaaaactccaagaattataactgttagagctgaagatggatttagttcaacagctaaaataattgaatatggaagagatttaggcaggttaagatatgacataaacgagcttgttgtctgggaagaaagcattaatgttttagaaaatgaaatattcttaatgcaggcggttcatcaagaaagtatagttattcctgaaaatattgattgtattagggcaatgcttcagatggaagaagataacttcaaatcaattgaaaagacaaataaagctatgggtatccaataaatctaattttttcttttttatttttacattatatttatgactctaaatatttgagtctataatactacaaaaatttttaatattagtaaaataacttttaattaaaaagaaagtgttatcttcatactcttaaccgaaagtcttatatatcataatactaatctaaattttagtattaacaggtggtattatggacgacatagataggaaagctataagcttattaatggacgccaccttaatgagtgaggatgaaattgaaaggacattaaaaatattaagaaacatggcaaggattaaaaaaagaaaggaaaagaatttaaaatcaataagagacgttttagattactgggcttgtcaagcttataagtcttcaatgaaggcttaagtatcctattacgtcttttttaaggaaaattttttaagttataaaattgaaagcaaaattaagataaatactcctataatccctccgactgctattatcaataagtttattaaattcaagtgtatatgtgtaattccaaggaaatttaaaattcctaccaaaatcaaaccaacaattgtatttattgctaagtatcttaatattttaaaggttaatttaaagaataaaatccccactataattattaatatcaataaaattatatgctctaatcccataaatatccacctcataaaataatattattaattaacttaaataaaaacttttgtgtgattcatgatgattaaaattgtatatattacaaagagaggaaaaaaaatagctgaagaaattaaagatgttttagattattaccactatgataataaagtagagcctataaaagattttaagatagagagaaatgaggggggctttatatttataatggcaactggaatagttttgagaaaatttttggatgagattaaaaatgataaatttaaagacccttttgttattatttgcaatgaaaataaagagctcatccctatactatcaaaccatttaggtggaggaaattatttttccaaattaatagctaacaatatcaatggtagagttatttttacaactgcaacagatgtcaatggtaaagttggcattgatgaactctccaagatgctatttttagaaactcctaagagaaaacatattttagatataaataagaagattttggaggaagatgttagcttaacccttccaaagtattggaaattaagaaatttgaatggctataaaattagctatcatgataagtatgaggttgtggttgatgactccataagattaaaacctttaaaaatagctgttggcttaggagcgagaaaaggcattgaaagatataaagtatattgggcggtaaaaaaagctttatttttgagaaatattccagtttggagagtggatgcctttgccacaatagaagacaaaaagcatgaaagaggaattttagaaacagtaaataaatttaaaaaacccctaattatttttaaaagagaagaaattaatgaaatttatgaaaaaatagatttggaaaagtcagagtttgtatataagcacttaggagtttatggagtttctgagccagcatcaatattagctgtcaaaaaattaacaaataaagattttgatagcataaaattgatattaaaaaagtttaagagaaatggggttactgtagcaatagctactgaaaatctttaatcgtctctttttaaatataatgtataagttgggaatgcaaattcaattccttttctatcaaattcctcttttattttcaaattaacttcatttatcgtgctaatatacttttgataaccattatatctgctgtttttaatataataaactacttggatatttagactccaatctccaaattccttaaaataaactgttattggttcatcctctacatttggatgttctaagaggatattttttataatttcctctgccttccttattttttcaactggtgtattataagttactcctatagttgttgaaaccttccacttatttttagatggaacattttgaataatttcatctataagttttgagtttggaactacgattattgagttgtctgttgcccttatctttgtgcttcttattccaatatcttcaacaattccactaccaccactgaaagttatccaatttccaatcttaaatggtttatcagttaaaattatcaaaccagcgattaaattagaaacaagattttgagacgctaaagccacagctaaaccaccaatacccaaaccagcaagtaaagtttttatatcatacccaagattgctcaaaattaacaacaatccaacaacccacacaactaatctaacgagctttttggttaaaacaacaatttggtcatcaacatctttttttgtcttttttgatattgttagggctaaatacctttctacaagttcattaagaaatctgtcaaaaaatacaacaacacacaatataaaggcagttaaaatcccttcatttactgctgtttttaatgaggggagaagatacagaaaatttactccaaagtaaaatccagataatattattgctattgctacaggtagagataaagccctaattagaagttcatccaattctataccgctctttttatgcaatttatctgcaagtctttcgataagtgcatttgcatatttcccaataacaataaataaaataattgagattagagacagaatataattatatacagtattgtgcattaaaatctcacttatcatttgagttattgtcattataccctcagttaaaaagaaaaattaaaaattaaaaataatttattggccaaccttttgctctattttttgttcttctttctcctcttcaccatacaatatttttgctatctgttttaatgtttcaataccctttgcctcagttcttaagagagggacataggcaataaccttgtctccaaatttctctttaatcatctctaatctcttcaactgcaactctcttcttgctctacagaaatcacactgaacatcctctggaatgagttgatttacaataactgcatcgattggaataccatacttttgaagagctttcattgccctctcactctctaagatactcatctcctctggaataaccactaatctaaatgcagttctctctgggtctgataagatgtttcttgctctaactattctctccttcatcttctctaattcttccaacatcttatcgtaatcgatatcttcatctttacctccaaatggtaaaagctttttcatcatcttcataaatccgctcatctgcttcctcaactttataagctttgtcatatacttgtccataacctctggcattcctaaaaaccttaaagtgtgtccagttggagcggtgtcaaatataactacatcaaactcattgctatccatatatttgaggaaaacatcaaatgcagcactttcatcagttcctggggagagagcggccatctctaattggtcttctaacatctctcctaagaatgggttttcttcaatttgagcttttaatttttctttatactcttccatagccttctgtgggtctatctctacaacatataggttgtcatagcccttaacctttgttggctcatgtccaaactcttgctcaaagatatctctcaaagagtgagctgggtctgttgagacgataacaactttcagtcctttttcagccaaataaactcctgttgcagcactcattgttgtttttccaactcctcctttacctccgaacatgatgtatttagttccatccttcttttccaattttttctctgtaattcctctcaatgagtttattgaatctttaatttttgataacatttattttcaccctcttattattataatgattttaatcttgtaattagttcatcaacatcgaccaaagtatttatacaaccatcccttaataaaggttgtccttgtgaaggaataccttttcttgataacatgttcatcccatagaataaatccctattgcatgcgacaccgaaaacggcttctggcttctcttcctttaaaattctctttaaaaacgtagaaccaggaactatataaactttataccccttttcttcagcaacttttataatttcccctactctacatctattgcaaaatatacattcaacaccctttggcgttagcttagctgggcattttgtatctctgaggcaatggggcaatattaaaactctcttcttagcttttttaaatctatcctcataatatttattgtagaactctatacctaccctataaaatgtgtcttcagttcctataaggaggaatatcttcaatagtattgaatagaggttatccatcaaaaataaagccaagcttgggaatatcaatttattcttttttagtaatatatagctaatgattaaaattaggatgaatgatataaatgccagtgcaaatatagctattgttatcattccaacaagttgtaaaaatccatctaatcctaagatgcttatcacctcagatattccaaaaatttataaaaattaaaatggttgatagcatgataactctatgtaacagatttactgaatataaatgtggaaatgtagctatagtggttgatgttttaagggcatctactacaataacaacactcctatcatttatagatgaagtatatataactacatcaacatctaaaaaagaaaatgccatatacattggagagagaaaaggaagaaagatagaaggatttgattttggaaactccccaactgagattttagcaaataaagatattataaaagaaagatatgaaaatggagaaaaggtgattttaacaaccacaaatggaacgagggttttaaaaagcttagatgctgagcatatttttataggggcaattgttaatgcaaagtatgttgctaaggcggttgaagattttgaagatgtgagcttagtcccctgccatagagaaaataactttgcaatagatgactttattggatgtggagttatagctaaatatctaaatggagagtttgatgaatttatcaaggctgctttagaattaactaaacatgattggatgtctttgattttaaattcgtcatctgcagagaatttaaagaatcttggttatgagaaagatgttacgtttgcaatattggaaaatagtatagatgcagttggaatatataaaaaagataagagcaaagttgttagatttaaataaaattttgtgataacatgagaatcgatataaacagaatagaaaaggaagaggatataaaattacttaaagaactgaaatggaatggatttgttttttatcagtatgatgatgaattcagcaaagatagatatgaagaggttaaagcaatagctgagagttataaattaaaggtatattctggagttaaaataaagacagaaagttctaaacaactaagggataaggtaaaaaagtttagaaataaatgccacattatattgattgaaggaggggttttaaagataaatagggctgcagttgagttgcatgatgttgatatattatcaactcctgaacttggaaggaaagatagtggaatagaccatgtattggcaagattggcatcaaatcatagagttgctattgaactcaattttaagactcttttaaataaagatggctatgaaagggcaagaactttgctattttttagaaacaacttaaaattggctaagaagtttgatgtgcctgttgttatatctacagatgctgaaaataaatatcagataaaaaatccttatgatttaagagcttttttaaatacgttggttgagccgttgtatgcaaaaaagattatggaaactgcctataagatatgtgattttagggattatttgatgagagataatgttgttagatatggagtggaaattataaaagaagaaaaagaatgaaaaaagaataattatagttttttacgattattaaaaattaaaaatgatatttgaacgccctaaaggcgttcatcagtgcattatatatctaaatatctgcaaaaagttataaaattactgtgctattgattgtatttggttaggatttaaattatttaattgatttaacacctcttcttttgctattgcagaaacatctatctcttgctgaatatctattggaatatttacttttgttatgaataaattaactgctatatctcccttaatctcaatagggatttttgtgcttttttcttttaaagctacttcaacaagttttttattagatattgttactggcaaagtgaaagtagtatttccagaggttattttaatgttactctgctctccgtgtcctaaatatatcttatctccaccaactaaagcataaatatcaaatgaaattttatctatgctaataccaataggatttggattatcaaccaacacttgaatttctatctttgtgttatctgcatctactttttgaattttctgcccaactacttcaatctttggctgctccaaacatccagaaaaacccactgccaaacatacggcaaaagctaataggaggagttttttgacactcttcataatatcaccaaatattcatttttgttataaaacatattaatatcttttcacaacaatattaaatataaactaaaaaggttgaaactttgagagagatttatagacaaacaatccatttagtttttggagttttaatagcattttcagttttaatatttaaaaaacaattaataattccattaattgttagtatagttattggtatctgcctatattttttatgtaaaagatattacataccaatagtatcagatttattaaatctctgtaaaagagaaaaagaggatggaaaaggagcgatatactttgctattggtatgttaatctcattaattttaattgatgatataaaagctgtattttttggcatcttggtatttgctgttggggattctttagctactataataggcattagaggaaaattaaaaataaaatactttggaaaaacggttgagggatttttagcattttttatctctgcctcattaattttatatccattttatggaacttatgggattttcgtagctttaatctcagcatttattgaatttgtaagtaagaaaataagaatagatgacaatctctatcttccttttattgtggcatttataatcaatcatcaaataaatatctgttctctaatgaactttatataaaagccaaaggctttttataaataccttattcattattacaagatttgatgattgattattctaataggactttcgcaggaataattatttattgcataatgacaccctaaaggtgtctaagttccaaagtttaacatataaactgcgaaagtcctattctaagtatttacccatataggccccaactctttcatatcctaactttctataatattctctaactccaataccacttgtcaccaaaatctttttctttccaaattcttctttggctattctctctgcctcttctaaaagttttcttccataacctttatgttgccaagttatttctttcaaatccttagttaatggtttttcttgcccacagacatggagttgcctaactaacattgtgttatcgtcaatctcttttctaaatggtttataaggctctctcaatcttaaaaatgctatcaagatatcgtttttcacatcttcataggataggaatatctcagttcctccacttgcctcatattcttctctgcatagttttatatgctcaatatccggcattattccttttttatacatgacatgtccaacttctctgcatcttatacacttacatttaattccatgcttttccatgtatttataaaccaactctcccaaattactcttcttaactccatcaactatcacagtagctggaatgtccctctgaatccttgaagttctaacccattttggcattattgattttgcatagctaattatctctattgcctcttcctctctgtatggtttatactctcctctcttccacatttcatagagttcagttccttcaataaccaaacatggatagattttaaccatatccggcttgaaatctgggttttcaaagatttctttaaacatttttttatccatctccatatctgagccaggcattccaggcattagatgataagaaacctttaaaccactatcctttaatagttgggtggcttttatagtgtcttcaactgtatgccctctcttacagaattctaaaatctcattatatattgtttgaactcccaactctacccttgtagctcccaactttagcatctgatttatttccttttctccacaataatctggccttgtttctatacagagagctacgcatctatgttctgcagtttcatttatcttttgggcttcctctaagctacttgcatcaacgccattcatggcatctaagcatctcttaataaaccaatcttgatattctatatctcttgctggaaatgttcctcccattataattaattcaattttatttgttggatgccctaccttttccaactgctcaatccttgcctttgtttgtaaatatgggtcgaagttgaacatcaaacctctcatagtggctggctctcttccagtgtagctttgtggcacatctccaaatacacttccaactcctccggggcagaagatacattttccatgagggcatttttctggagatgtcatcactgctacaacagcaacaccagagattgtcctgacaggcttctttcttaatattgggattaatatcttcttttcctcttcagttgcatactgcaaaatctcagagtttgatggatgcccaataccaattctatgtattcttaaacactctgccttaatctgttcaattctctttttatccaaggtttttcctttgttgtattcatctaagattctttcaatgatgcatctcattaattttgccttttcatccatgataatcaccaataaactttaaacttacatatatgaatatatttataaaaatgatttatatatagaactttcgcaacttatatttttaaaaaggtatttggatgcctttaggcatcaatattcaataaaacattttattcctgcgaaagttctatatagtttattcggcaatgattataatgttattgtataattgtagtatttggtttaataaagtagtggtgattaaatgctaactcatgttgatgataaaggcgttaagatggttgatatttctaaaaaagaagatgttgagagaatatgtgttgctgaaggatacataaaattaaaaccagaaacaattaaattaataaaagaacaaaaaattaaaaagggaaatgtcttaacaactgcacaaatagctggaatcttggcagttaaaaaaacttatgagctaattccaatgtgccatcctctaccaataacttcagttaatgttgattttgaggtatttgaagataagataaaggcaatctgctcagtaaaaactacttataagacaggaattgagatggaagctttaactggtgtctctatagctttattaacaatttgggatatggttaaatctgctgaaaaggatgaggatgggcagtacaaaactgctgagatttttgggattagggttgttgaaaagataaagaaatagtttatttaggggattgcaatgattgattctaactttgacattgttctttgggttaggatgattaaagaagggattgaaaagaaaaatctaaatccttgggatgttaatattgctgaaattgccgattactatatacaaaagattaaagagcttaagaagtttgatattcgattatctgccgatgttattcttgttgctggtatattgttgagaatgaaatctgaagctttatatgacgaatgtaaggttgaggaagaagaggattatgattattgcgatgattattatgattatgatgatatagaagagaaacctaaaaaaggcaaaaagaaagaaaaagaagataaagataaaaataaaaaaagtaaaaaaccagttactgttgatgaattaattaaaacaattgaaaaagagctaaataaggttaaaaaatccagaaagaatagagagaaaaagacaaatgaggttgaagaaattatagaggagcttatagaagaggatgatatctccgatataatagctgagttgttagatgatttgatgaaagagggaattatagtttatcaggaaaagtttaaaacaagagaggatagggttagatactttatcccttctttatacttagctaatgatggaaaggcagagttgattcaagaaaaattgtttggagagttgataattaaacttaaatctttttaaatcattcctttttaccttcaactcatttatcaggaatcttggctctctcaaaatgctctctacctttaatcaaactcatagttgcatctacccccacttttgctgttagtttattttttaaatcactcgaaggatctaaagaagaacctttggctccagaaataataactatatctttatctccttgaacccttgtggctattgcatactcaacatcatttatatcaaatatatttatgtcatcatcaactacaatcacatgcttcaaacttggatgggaagcaaatgctgccaatatagcatttttcccatctccttctgtcctcttctctatctgaacaacagcatgaagccagcaacaacctccctcagttaaaacaatattttttactgtcggaacggtatttctaactcccttcaaaattcttggctcttgaggcattcccatcaatgttttatgttcaatccctcccggtaataaagcgtggaatataggtttttccttcctataaagtttctcaatcttaattattggctgctttctaacaatatcataagttccagttatatctacaaaaggcccctcatcatcaacctctggcaatatcttaccctcaatgataaactctgcctctggaactaacaagccattatccaactcaaaaacccctatctctcctcccaacaaagcagctgcaaattttagctcatcaaatgttatatcagcagaggtagagccagccaacaaaacagctggatgaactcctataactatagcaacatccaaatatcccttttcctttagagctttattatataaaaagtgtaaatgcctttgttcaaccattcttataactaaataatcatctttaaccaaaattctatgaattgataagttatagccgtaatctttatcatagacaacaacaaccccacttgttatataagctcccgcatccttctcgtagtatattggaattggccagtttttaatattctctgggatttcaacaatatatttctctttcaatttattgtttatctttaattttccttctttttccttttccattgcatcaagcataaagaatataaaatcctcctttttaacattaaaaatctttgaaagggtttccctactgcaaagatttccaacaacttcaaatccatttacatcttttatataaactggttttccatcatatttttttaatattcttgaaactccaaactttttatcggctttgtctattataatgggattaagtttattaatgatttctctcatgataccaccaaagtttttatagttttttgcaaagtaataaaatttattaaggaaagtttaaacgccttccaaaaggaaggcgttcataaatacctttttatcctaaaatgttttgcaaaaaactatatatatttcttagccaattttaatattaatcttattctttgcttaatatttaaagtgataacatgcacaaagagcagttaatgaaacttcatcaattttttgtttatgttgtaaaagaaattatggatgataatttagaaaatactgacaatgaatgtaaaaaattatttaaaatttatgagatgttagacattaggccccatcacattcatcgacttaaaagcgaacaaaaagcagcgatattactgttatctgcttgtgttgccagttacttagccaataatatggataatgtccccaaaaacttagccaaaaaacttgaagaaaacgcttttaaacatttaaacagttgtaagaaaaacattattatattagaagaaaatgaaaataacggtgaaagtgctgaaaaggaagaataatttaaaggtgatatttttatgtttgacccaaaaaaatttattgatgaggcagtagaagaaataaaacagcaaattagtgacagaaaagcaataattgccttaagtggaggggtagatagctccgtcgctgccgtcttaacccacaaagcaattggagataaattaacagctgtttttgttgatactggattgatgagaaagggagagagggaagaagttgaaaaaacttttagagacaagttgggattaaacttaattgttgtagatgcaaaggatagatttttaaatgccctaaaaggagttacagacccagaggagaagagaaagattattggaaagttatttattgatgtctttgaggagattgctgaagatataaaggcagaggttttagtgcaagggactatagccccagattggattgaaacacaagggaagataaagagccatcataacgttgccctacctcacggaatggttttagaggttgttgaaccattgagagagctttataaagatgaagttagattgttggcaaaagaattagggctaccagatagcatcgtctatagacaaccattcccagggccaggattagctgttagagttttaggggaggttacagaagaaaagctaaacatctgcagagaggcaaatgcaatagttgaggaagaagttaaaaaagccaacttagataaagatttatggcaatactttgccgttgttttggactgtaaagcaactggagttaagggagatgaaagggaatacaactggattgtcgccttaagaatggttaaatcattggatgctatgacagcacacgttccagagattccttttgatttgttgaagaggattagtaaaagaattacatcagaaattccaaatgttgcaagagtagtgtttgatataactgataagccaccagctacaattgaatttgaataaaaaaacttttttaaacttttttagtttattatattgacattaactatttaactattttggcaatttaaatattataatagtataattgagtgataatatgatttgcttaggattagaaggaactgcagaaaaaactggggtagggattgttacctctgatggagaggttttatttaataaaactatcatgtataaacccccaaaacagggtattaatccaagagaggctgctgaccatcatgctgaaacatttcctaagcttataaaagaggcttttgaagtagttgataaaaatgagattgatttaattgcattctcccaagggccgggattagggccgagtttgagggtaactgcaaccgtagcaagaactttatctttaacattaaaaaaaccaataattggggttaatcattgcattgcccatatagagattggtaagctaactacagaggcagaagaccctctaactctatatgttagtggtggaaacacccaagttatagcttatgtctcaaaaaaatatagggtatttggagagacgttagatatagctgttggtaactgcttagaccagtttgcaagatatgtgaatttgccacatcccggggggccttatatagaggaattggcaaggaaagggaaaaagcttgttgatttaccttacactgttaaaggcatggatatagcattctctggattgctaacagcggctatgagagcttatgatgctggagagagattggaagatatctgctactccctacaagaatatgccttctcaatgctaactgagattacagaaagggctttagctcacacaaataaaggagaggtcatgctcgttggtggagtagcggcaaataacagattgagagagatgctcaaagctatgtgtgagggtcagaatgttgatttttacgtccctcctaaggagttttgtggagacaatggagctatgattgcatggcttggtttattgatgcataaaaatggaagatggatgagtttggatgaaacaaagataattccaaattataggactgatatggttgaagttaattggataaaagaaattaaaggcaagaagagaaagattccagaacatttaattggtaagggggcagaggcagatattaagagagatagctatttagattttgatgtaattattaaggagagagttaaaaaaggctatagggatgagagattagatgaaaatataagaaagagtagaactgcaagagaggcaaggtatttagcattggttaaagattttggtatcccagctccatacatatttgatgttgatttagataacaagagaattatgatgagttatatcaacggaaagttagctaaggatgttattgaggataatttagatattgcatacaaaattggagaaatcgttggaaaactgcataaaaacgatgtaattcataatgacttaactacatccaactttatatttgataaagatttatatatcattgattttggtttaggaaagatttcaaatcttgatgaagataaggcagttgatttaatcgtctttaaaaaggctgtgttatcaactcatcatgaaaagtttgatgaaatctgggagagatttttagagggttataaaagtgtttatgataggtgggagattatactggagttaatgaaggatgttgaaagaagagcaagatatgtagagtaaatatttaaaattttttaagtggtatgatttttccacttatgagtaaaaaaaatgtaaaaatagaagtatttatataatgagcaaatactaaaaaattatttaaaatctcttctgaggtgtaagatatggtaacaaaggaagatgttttaaatgccctaaaaacagttgcagacccgcacatgggaataagcattgtagatatgggattaattagagatgtggaggttgatgatgagggtaatgtaaaatttaagctcattcctacaaacccttactgtatgagtgttatggcaatggcttttcaggcaaaggaagcagttaaatcattggaaggtgttaaaaaagttgaggttactgtagaagggcatgtaatggagaaggacattaatgagatgcttaaagagaaagaataaaagtgattcttatgaagaaatttgaaattattctttttttatttatagccgttttaatctttgttttcggatattttgttggagcatctcaacctttatattctgaaaatccagttatccaatatttcaaaaatccaaaaccttttacagttgaaaatgtaaatatgccagttacttactatggcacgatatgtggaaagtatattggttatcagataactccccacaatgtcaatgaagaggcaagaaaatgtttctataaatattttaagttaaaagataaaaatcctaaagaggctgagagatatttaaaaagaggactatttttaacagagtatctaatatctcaagcagataaagaaactgctgaagtagatgaaaagaacatcacttttattgtttggaggtataattttgaattcccactttataatctatctaagggttggagaggagcattatgccaagcaggctgcttaaagaccttatatttagcttatgaagctactggagatgagaggtatttaaattatgcaaatttagccataaatgccttcaaagttcctgttgaaaaaggagggttattaaaaatcagaatctataaaaataaaagctactattggtttccagagtatgcatctgaaaatccaccctatgtgctaaatgggtttatcacagccactctatggattggagactttggaaacaaaacagggaacgctgatgctctatacctttacaaagaaggtttaaaatcaataaaaacatttcttccaatgtatgatgctggagattggagttattacgatgctttaggtcatagatgcaataaacattatgaacatctacatagactgcagatgctatggctttacaataaaacaggagatgagatatacctaaaatactacaaaaaatggagagaatagttacaattctaaatccatatcataaatcctctctatattctccttatggattttataaacaccctcttcatccaaaactcccttctcaatcaatctccttgtaactcttgggactgtttttattcctaaggcaactcctggcctttttaaatcatcaatatagtcagtttccataacaaaccttaaagattttttaacaacgtcttcatttactcttgatgctaaaattgaaggaaaaataccatatctctctccctccaaaaccatattcccacaatgatgcttaacgaccttttctggattcaatccaacctctttagccatttcagaaaactctttaaactgctcttctgttgaactctcagcatgaatttggattgcacaaccaatatcttttgccaattccatacaatattttaaaatctcatttgatgctttccaaacatcttcacttacaggatagtgaggtcttccaacttcaccaattcctacaataaaatcatactcctcaacaagcttttttgcataatttaaggcatcaacaattctttgttttgcctcctccaagctcataaatttcatcaagtatgttagctcagctggatgaactccaactaatccaaaagctttaactggtgtgtttttgtttattatctcaacatctctaactaagatgtccattgatgctgttaggtttccatcaaatgttggtttatttaaaactatcattacctttcctccagcgttatagaatgttttagctaccttttcagctccatagccgtgtttgtcatcaacatgtatatgattgtcagtaacaggcagactttttagaacatccatattttcaccagatttaatttaaatttttctaattatacctctgagcgtatttcactaaatttatactgcagatttatgcagctttaaaatcctatttacatctctttcttttgctctgaatgttattatatgcttgttatcttctaagatatcttcaataatctcagtgttctcatacaaataggatataagccttggattgtctgtctcaatagttccgatggagagattgagatgctctataatcatctccttaagtaaatccatatttatgtcgtattttgcagagacaaatattggattcactatgtatctatctaactcttctaaaatttttctctttttttcctttgtaatcttatctactttgttaaatacagttattattggggctttgcaattaattttacttaaaatttcatgatttacctttaattttcttttaatttcttcaatatcatcggacgcatctacaacaattaatatcaaatcgctgtctgcactctcttcaattgttgataagaatgcctcaatcataaatgggggcaaatcatcaataaatccaactgtatcggtaaccaatatctttctcttaataccttttatagcccttgttgttgtagttaatgttgtaaaaacctgattttttgattctttgttctctccagttaatgcatttaataagctggtttttcctgcgtttgtataaccaattaaaccaacagtatcaaatttagcccttcctttccttgctacccttctatgctccctgagcttttctaattttctttttattgttgctatctccctttttaccttttggtagtatttttcaacttcataatccccatatcctccaaatcccggctgttcccccatctttgctaatcttactttctcccttgcccttggtaactcatactgcaattctgccaatctaacctgcaattgagcttctttagttcttgcatgcttatagaatatccttaaaacaagctcaatcttatcaataacttcaactttaaatttcttagctaagttgtatttttgtgaaggagttaagatatttccaactataacaatctctatattctcctctttaatattttcagcgattctttcaactaatccactaccaatttgatactttgggtcagcttttctaatttgaactattgtttttactgggttatagagaacttcagctaattctttaagctcctctatactttttctatcaaatttactgtcttttcttaaaattaacaatgcccttcttttaattctatctcccccatttaatttttaaattttaaattgttaaaatatattatggaaattcaatatataaatcttgtccttattaaaaaagaaaatagagtctaagtcaatttataaaagactcatctttataaacaagcgtttaagaaatatggtttcgaagttattgaagactaaaatattcaatatatattgcaattgttacaatagtttatctcattaataaatttttaataagctcatagtttcttgtaaaaaattttgtaataaaaaaaggcataaatgaatgcttttaggatgttcaaatttccttaattaattttaataactttgcaaaaacaactatgatggtgaaaaatacaatagatgttaaagaaatattaagagagttagatacaaccagaattaaagactatcctttaatgagtggaaaagagattttgttgaggactaattttaagggttgttgtgggatgccttcacagataagccagttgaatttaaaggaacaattagagagctgttagataaaggaaatagagctgagataattgccactttaaatgctgttatgagatgtgcaaaaaagttagttgaatatttaaagaattaaaaccagaaaagattggaattattggatttcagccagcgttaaagagattgttaatacctttagttctgaaaatgtcatagttagtgatttaaatccagaaaatgttggaaaaataaaatatgggctagtagctttagcaagagctttagttgtagaaccgaggttattttattagataaaccgctaaataccttatttctgaccttctctccgagataaagctcggagcttccttagcgacaataaatggtgaatccaacttaaaagttaaattcaaaaatttaaaaacttagtttttgctgtccaaatttaactcccaactcatccaaaatctttttagctattttttctccaataattgaagccacttttgaagggttgtttataatatcctcaatacttctaattccagcattatacagctttcttgctctaacccttccaatatactttatgctcaacaactcaataatatcttccttagctccatattctaaccttatctccaacttctctggaatgtctgagcttttaccaattaatttagcaatctcttttaatgcatgcattatccaaacagcattttcaaccttatatctcaaaatccctggttcaatcttatatctctttaaaatttcatcttctggaacttcattaatccaatcatacagcatcttagctgttttaaatgcctctaaatcctcaatctcaaagctttttattccaagagagtccatttcatcaattaaatttaactcttcagagttataaactcttaaatttggcatcatctccaaggtttttgaaattaggtagagataataaatctcttcttcattctccatctcttccaatccatctatgatgaatttagctgacaatgggtctatgtagagttcagaaactctctttcctaattctgttggcataaaatcaataataaactcattctcttccaaaaatctaatgacttcattaatatttttagcaacttccctcaaatttccatattgatgagcatagaaggtatttcttataaaccattctaaatcatactcatctctaatctctccagtagcaataagtcctaaaagttgagttcttaaaactgcttgatttgagagctttgaatatattggctctggtttttgcgtcaatgcctgataagcccttaaataatctctatcattctttgctacgattatcccttctccatatgggtctaatcctggtcttccagctcttcctatacattgttggatttccattattgggatgtatctcatccctttatttgtaaatcttgttaagtctttaactattgcccttctacacggtaagttcagcccagcagagttatgcactataaatccatttgccacaatataatggctgttgcttccatcgtctggcagttctatgtcataggcatacttgtcatttacttttatctttttaatttctttaattctatcccaataaatgtctccatcatagcattcttttttccagctatatctcatctctttatgaattggcttaccacaaattggacatttttcgagatttactaaaaagttatacatctcttctaagttttctttatcttttatgtgtttatttaggagactcattaaaactctgcctttttcatttaaagagtaataattgtttccattaattttttctcttacaataaagtcaaaataaggattttttctctttgaataatattctttatagtttgtaattaatttttttccatccaatagttcaaaaagtaattttacacgttttttatttaactctctctgccttttagttcttggtttaaacatggtcaaatcaacactaaatccacaatcacaccatattttggcaatcggagtgaagcggagagctacaaattccgaaggaatttgtccaatttctttattttttatgatttcttctaattttcttctcttctcttcatgtcttagtgggatgttctcataaaatctttttatactcataaaatctctaattgttaatacataaatgtctttacatttgtattctttgccatttgttggagataccatagttttagttttcttttttctaatactgctatgaatcccaaatcttaacaatacaaactgtaattgttcaaccaatttttcagatattgaatagaattcaatgttttttctatttaagtatatatatccatcactatcaaacaatcctgcaataagatatgctaacttatccaatggaagattacaaaatgcatcaatgtttttgttatcttttgtgagcatatttaatttattaaagatttttcttagttttttcgagtatatataatgagcaacaccttttgatattctacatttcaaaaagtattttttgtgaagttcagaatcatcaaaatttgggggatattttggattaaatgcaaggtctggagtggctttaagagtatttttttctataactccggtataaccatctcctatgaaatatccaatgaaataaaggtctccattagataaatcaatatctttctccttaactcttattctatcaactgtcgctacataatctccaacttttaaatcctttgcctctttttcttttaaagaaccattttctttaactaaaaatatatgatttggagttgtagtgatttctaaaccatttactgtttttacaacgatgttgtattcatgctgtggagttttatggactttccaaccatctactggttttatctcctttccacataatgcaaagactttttcgtctttatttaattcagtaattttcctaaatccgctctcttgcagtatttcagtgtttgcatttaggcagagtgtaggagtgcaacagataaccttaattaacctctttctaaacgcatcttcaacaatctttctatgctgataagttaaaccagcatgatgaaaggcagagccgtttaagatgcattcagctaaggttttacacatctcagttggtggctctaagatagataaaatctcttcagctatttcttttaatcttattttttcctcttcagttaaaaatttctttaaatttaatttctttgcctcattaacggcatttcttttggtgttgcagaatactaaacagcatcctccttcctttacacaatcaacaactaagttgtaaatatcgttattatcaactgcctttatctctctaatttctccatttataaactctatggcttcatttttgtaaatgccttttttcaactcaacaggtctccaatcatcaactataagctcagcattaagccactcagccaactcatctggatttccaatagttgcagataaaccaataatttgtacattgaactcttttaatttagtcaataaaatctctaacgtccctcctcttgtttcatcattaattagatgaatttcatcaaccacaacaacagaaacatcattaatccagtcaattttatgtctccatagagagtcaagtttctcagctgtcgttataattaaatgatatttgcttaaatcctcatcttcatcataatcccctattgataaggctattctcaacccataccgctcatatttgcttttaaactcctcatacttctctgatgccaatgcctttaaaggcactatgaagataccctttttgtttgtaggatttttattcccatccaataagtgatttattaaagccatctctccaattagtgtttttccagatgctgttggaatagatattaaaaaatttttattcttatccaataatcctctttccaatgcctttttctgtggtggccttagctctacaatgccaaaatcctttaaaatctctaagattttatccattcttatacctccagttaaatcttttcagcagaaatagctacaaatccaccttctccataaccttctttaacttcaaccttatcaactttatcaatttctttaaaaatcgtttgtgtggcttttatatttttaaatcctaattcttttagcatttctataacttccttagctgataaaaaatttgcatctttgtagaatttacttttttgctttttttcttcatacatctttcctaaaaagctatccctatcaataattccaataattatctttcctcctctttttaaaaccctttttgcctcttctatcatcttttttggattttctgcaaactctaagacagtatttattaaaaaaaaatcaaactcttcatctttgaaaggcaaatcttcaccttttgctattataacttttattcctctcttttcagctattttagccatttctttcgatatatcaacaccaatttttatattaaaaggtttagcaaatcttccggttcctactcctatctctaaacctcttccttttggaatatgtctttttaatgcttcaatctctgatttataaataatttcattttcatcaaaccatttatcgtattcctcagcgtatttatcaaaaacattcatggttattcccccttattacaaattctaacatttttataatattacaaaattataaaatattatcattgaggtgataaatatggcaactataactatagatgatgatgtttataaagaattattaaaacttaaaggtagaaagtcagtttcagagtttataaaagaattgttggaagagagaaagagaaaaaacttggatgtttttatgattgcctttggttcaagaagtgaggaggatgtagaaaaattaaaaaaagaacttaaagaggcagaaaaatggatgcagtcattgatacaagtgtaataatagagatatttagaggaaataaagatactctatatcaaatttgtgattacaactgtaaaataacatccataacagtttttgagttatattgtggtaatctaaaagaaaatgaaatgataatgattgacagcttaccaaaactaaattttgatgataaatcatcaaagattgctggcaatatatttaaaaaactaaaaaaagaaggcaaaattccatcagtaaaagatttattaattgcgtcaatattttattaacctacgataatgattttaaaatgtttgaaaagttcggcttaagagtgaagattttataaataatttaattcaaattttaaaacccaatttttttatttttttaatttcttttttatcaatttcaatatctttaccaaagctaataaaatttattgcatgaactgtcttttcataaaagttaggataaattacattaaaatctccatctatatatctcaataaactctcatttaaaaataagctatagccctcattaactaactctatagctctaaacggattttttacccttactttaactttaaattttataccttctttctttaaaatgttataaactatcctctgtgagctaaatcttatgccaactaagtttttataattaaactcttttttactaaccattacaaagttgtcgtaggcaattaaaaatatgttaaaatcacaactcccaatctctgactttaaaaatctctcatctcccaacctataaatccaatagctgtcatcaacccctaagacatcaacaaaccccatctttagcaattttaaagcgttatcaaaagaggttattattggatttccaaataatattttggcaatctccccactcacaaatccagaaactgtaaaaaagtgattttttaatcttttgctatatgagttgtaagtttctaaaatctctaagccagcatcagttaaaaccgtcccatttggtgaggagtaataaagcttaacccctaacttattctccaatctttttaattgaatattaaaagaggaaggctttatatttaataacttagctgcctcattttgggattttgttttatgtaaggcaattaaaagttttatttgatttggagtaattaattttcctctatattcaatggttaaatctactttcataatttaccagccaatatttatcaatttggcgtcataaaccattactgcatctccaatcatataaactccatcatctttaatctcaatctccaaatctccaccatctaagtgagctaaaaccctattatttgttttaccaagtttgtgagccataattacagaagctgttgttcctgttccgcatgcagttgtgtatccagctcccctctcccaggtaacaatcctaatttcattaggattcaaaacttttacaaaatgcacattaattctctctgggaatgcttcatggtgttctatctctttcccaataacatccaagtgttctctaacaaaatctaaatctatgttgttatcttcaacaaatataaccgcatgtggatttccaacattaacgacactcaacttgaccttaggtaaatatggattctttaattttaactctccattcaaaaattcatcatcctctttataaccatcaacaaccattggtatatcttttaatttaaactttggaactcccatataaactttaatcttctttacttcatctccttctatctccatttcagatactcttaagcccccttttgtctctacttttaaaggattttttttcattattctctcataaacgtattttgaaaaacatctaattccattaccacacatctctgcctcagagccgtcactgttaaatattctaaatcttacatcgtattcatcagatgttggcttttggatgaaaataactccatcagcacctactgaaaaacctcttctacaaatttttcttgagaactctgctttttcttcttctttaactttttccccgtcaaattcattaataactatgtaatcattcccaagggcatgcatctttgtaaattccatattttcacaccaaaaatagttatttgtagctctttgtaaaacattttgtaataaagaaaggcatactttccttagttagtttttaatcacatttgcaaagaactattggttttttagtgttcagctacccttatatttactctattcaaatttgtttcatcgattacaacaacatctttaatagctactacaagtttataaggaattaagacgtttcttccttcttctctcattattgggctgtgttcagctggttctacttctaaagaaaccaatctaccaactttttcatcaaacacgatatctttaacttttcctattacgctacccttatttcctattatacttctctcaaacaataacttagctggcattttttccattttatccccattagatttttatatttataacccatcttttttcaaaagcatttcagcaagttttaaatcatctttagtatttatattgaatatcagctcatcaataaccataatttcttctttttgatatccatgctttggggatacaacatttatccctgcaggaactaagccgttgaaatcaattgaggggtttggatatttttcttttggaatcataacagctaatgcttcaacatctggagtcttagctttaatacaataaaaataatcaactatactattaataattttcgattttaagttaattaagtcagagctaacaactaagaatggttctgagaaatatccaatacattcatttaaatcttctatataacctttaccagatgtgtctataactacaatatttttgtaatctttatatgctgaatttatatattcctttgtctttggtgtatttggagaggtagcgataaatatattatttacctttgattttaataagggagagacaacataatctataagacatctaccacaaagcttaatcaacggcttttcaactccacccattcttgttcctttaccaccagccataattagagcatccattttaaaacctctaaggttatttataataaattgatttaatctttattaagatatttaaattaaaattttgcaaatatttagcataaaatgttaagttgtgttagctaatattaaaaaataaggtatatttaaaaatgtgagagacatgtgctctataagtggaataattgttaaagacaatcaaatatctgctaaatactccatagatatgatgaagattttaaagcacagagggagagataactctgggctgttgttggatgatgaagttatatattttaacgattttgaggatgttgaggatttagaggaggagatgattggaaacttaagcttggctcataatagattggcaattgttgggaggtatggagttcaacctattccaaatgaggatgaaactatatggttagtttgtaatggagagatttacaattatattgagttgagggaatatctaaaacaaaatcatgaatttaggacagacagtgataatgaggttataattcatctatatgaagaggagaagttggaagagttggatggagactatgcctttgccatatatgataaatctaagaatgttgtgaggttggcaagggatatgtttggagttaagccattattttatgtagatagggataaatactttgcctttgcctctgaaagaaaggcgttgtggcatctacttataaatatcgatggctgtgagagagatttagatgagctaaatagcaaaatcaaaacattgaagccaaattcacagttgatttattatttagatgataataggtttgaaattattgaaggctttaaaaagttggagttaaattacatgaaagagaggagttatgaggaggctaaggagtatttagatagagcattgaaaaactctgttttaaagagggtcaggggtttggacaaagttggaattatatgctctggaggagttgatagctcattgattgctaaattagcatctctatactgtgaagttatattgtatgccgttggaactgaaaatagtgaagatttaatctatgctgaaagattggctaaagatttaaatttaaagctaaggaagaagattatttcagaagaggagtatgaggagtatgtgtttaaggtagctaaggcaatagatgaagttgatttaatgaagattggagttggaatccctatctatgtagcttcagagatggcaaatgaggatggattaaaggttgttctatctgggcaaggagctgatgagttatttggaggctatgcaaggcatgagagaatttatagggagagaggggaggaggagctgaaaaaagagctattgaaggatgtttataatttatataaggtaaatttagagagagatgaccactgtacaatggctaatggtgttgagttgagagttcctttcttagatgaggaggttgttgaaattgctttatcaattcctattgaatataagatgtctgaacttagtaacagaccttacgcagagtctaatatttcattgaaaagtgagcccataaatgggctcaaaaataccaatttaaatataaagtgcgtaaggtctgttagaaagaagattttgagggatgttgcttcccagtatttgccagattatattgcctatagaccaaagaaagccgcacagtatggaagtggtggggagaagatgatttataaggttgctaagaaatatggattttcaaagaagagaattaatgagtttttagatatgttgaagaggaagattgttagtgaattttaaaattataagctagtgtgatacctatgtttaagaaaaaaccattgattgggatggttcatctaaaaccattgcctggtagttatcattacaatgacaactttgatgatattgtagattttgctataaaagaagctaaaaaacttgaagaagctggatttgatgctgtaatgatagaaaactttggagatgctccatttaaaaaagaggctgataagataaccattgcatcaatggctgtaatagcaaaagctataaaagaggaggtatctctcccattgggaataaatatcttaagaaacgatgctataggggcttactccatagcttatgttgttaaagcagattttattagagttaatgtcttatctggtgttgcatttacagaccaagggattatcgaaggcaaagcttatgaattagccaagctaaaaaagttgcttccaagtaagataaaggtttttgcagatgttcatgtaaagcatgcatatcattttatagactttgaaagctcattgttggataccgttgagagaggtttagctgatgctgtaattatcagcggtaagagaacgggaaaggaggttgatattgaaaagctaaaattagctaaggaattggttgatgttccagttattgttggttctggaacaaattataacaacctaagaatcctctggagctatgcagatggttttataattgggacatggataaagaaagatgggaaagccaataatgagattgatattgatagggctaaaaagattgtaaatttagctaataaattaaaaatgtgctaattttgatagaaagttatatatagaagttctaatatttttatttattgacaagaaatgaacaaaagtaggataatggtgatattatggacatagttgagaaagtatataaagaggggatattgaagttgaaagaaaacattcctcaaataataatcaatttagtagttgcaggtttaatttgggtatttggcattttagtgtttattccaattgctgatatgcttggaaatccatatttatttggattaactgctttaaagccaataatctcagcaataataaccatagctttaattattgtcttgctaagagttactaaagactttggggagttaatggatggaatagcagatataattgctgtaaaattagcaggaagtagggtaaatgaagaaaaacttaaaaaatacagaaggggcttaagaggattagcatacttaatcgttgctataatagcttatttattcttcttgcctgtaatttcaggaataactccagtattggctggaatagtgcttataatattagttttatgggcagttactgtgcttataaatataggacatatattctcagaagaaattgaagaaggcattagaatagctacagaaaaattagaaaaagcattagaaaagtcagtaaaaaatgaggaaaatgaataagggttaattatgaaatataaaaatatcctaattaatatctttttactgattttttggatatttttggcttatcttttaccatactatctatttgtttttaaatattttgaaaagtattttatgatggactttaaaagcattggtgcaatttttttaatagttttagttatccttgccattattaatctacttttattgcttagggaagtaaggaaaataataaaagaatttctataattttttagcaaaaaacatatatatcctaaactttaacttcttttatcttcattataaaggggatagttatggggcattattttatcaacttatttacatatacaataattgcttttatattttcagcagtattgtgtaaatttttaatgaagaagatgattaattataaatttggctatgatttgcataaaaaagagaagattaaagttccagagatggggggcttagcagtattgttttctaatgctttatttatcccatttgtaaatccaatttttgttttaccaataattactgctggaattataggaattgttgatgatatagctaagctctcaccaaaagaaaaattaatattgttatttatttctggtttgataataggaattttgttttataacaattcttatgttaatttgatagaaattttgattattgctttaggaatcatgatttcctcaaatttaactaatatgttagctggttttaatggattggagataggaatgggagttatagcttctatttcattagctttggttttattcttagataattatacaactggatttttatccgctttgatattctctgcatcctatttagggctattgatatttaacaaatatccagcaaaggtttttccaggagatgttggaactctaccaattggagctttcttagctgtcttagcagtagtttataaggaatatatcccatttttagttataatgatgccttatgtgatagatgcctctttaaaatatctaagtgctggggttatgagtagggatgagcataaaccaacaactctcaaagaagatgggaagctatactatataggtggctatctatccctaccaaggcttatattgaagtataaaccaatgagagagcctcacttagttacagttttatggataattgggatattctttggtatagttgggattttaatatcattaatagcatgatggtgattgttttgaaaaccataggaggaaacctcctattgggatacctcccgtccattaagttagggctttcagccctaattaatgtccattattaataacaataagttttagttcggtgattgttttgacaatagaggagatattaaaagaagttttaaatgaaataaagccttcaaaggaagatatggaaaaactgcaacttaaagctaatgaaatcattgataaaatttgggaaatagtcagagagaatagctatccaatcttagaggttttattggttggctcttcagcaagaaacacaaatttaaaggatgactatgatattgatatttttgtattgtttgacaaatcagttttctgaagatgaattagaagagattggattaaaaataggaacagaggcaataaagaggttaaacggctcttataacataaactatgcctctcatccctatgttaatggtgaagttgatggttatgaagttgatatagtcccatgctataagatagactttggagaaaaaataatatctgcagttgatagaactccattgcatcataaatttttaattagtaggttgaatgaaaggctttgtgatgaagttaggttgttaaaggcatttttaaagagtttgggattatatggttctgacgtaaaaactaaaggattctctggctatttatgtgagttgttgattctacactatggttcattcataaatctattaaaagaggctcaaaattggagaattgggaagaagataattttaaaagacatatttgaaatttataaagatgttgatattaataagctaaaaaagtttgatgaaccgtttattgtctatgacccagtagatttaaatagaaatgtagcctctccgttaagcaaagataacttctgcagattcatattctactcaagacaatttttaaaaaatccttctattgagttctttaaggactatgctaaaaagttagaggagattttggaaaatagagagcatggatatagattaatattaaaaatcccaagggagaatgttgttgatgacatcatctatccacagatggagaagcttcaaaaaagtataaataaagttattgttaaaaatgaatttgtaattttgaatagcaagtgttttgcagatgataactattgctatctgtattgggaatttttagtgtatgaactaccaaaaattgctttgagagaagggcctccggtatttgagaaggagagggcagagaggtttttaaagaagtatggtaaagtttttattagggattgtaagttatttgcctatacagagagagaatattctcacataatcgatttatttaaagacattgttaatgggaatttacagaatatctctattccgaagtatgtaaatccaagaaacggaaagattattgagttgaatagccatggagagcacaagcaatttaataaagaatgccaatgaatttttggattctttaaatgagattaacgataaattaaaagaggtagttggtaaaataaaaaacaaaacaattgataaaactaaattatctgatattatattaaccttagaaaaaaacttagagattttacaagatttaaaatcaaaaatggagtttttagagtttgattccccatataaaaatgttggaaagttgaaaggaggttatgatagtgaaggattacaagagattgcaagctacagcacatatttgagaagaatagcaagtgagaaaaaaggtatcttagagagggttagacatgccttagttgcccataaaattgccttagcccatttaactgaagatattggaaacataaatttacctccaaacttgcctttagatggttcttataaaaagataatgtttgaatttccaccttatttagtcacaacatataaagaatttttagatatcttagaaccaaagggtagagggattttaacatcctatacaatatcccttatagttattgataaaggaaagagagaatttaagagaattaaagttgaagacaaaaactatgagaaatacatcaaagagaagtttggaaatgctataattacatcaataaaaaggaatttctcaaaaaataagattatagatgaccagtatgttaggagagtattagctatcggctatctcaacacttacaaagatgagattgaaaaagcaataaatgaaaaaattgataaattgcttaatgaagaagaaaaaaaataccttaacagatatttagaactctgcttattatttagagaagaggcagatataagtgggggaattttagacgttagatgcatggaagaaagaaaattaaaagagcttgaacttaaagagattttggaaaaagaaggattatatagagatggagaaccaattgaaccgttaaaaaaggcaattaagattaaaaatgaattatctaaaaaaatatcaaaagatattttgataaagagattttctgaagatgtttttaaattttatctctacaaaacaccagatgagagggcaaggagtaatttgttcccatctattatgattactccacagagaggatttttatcttggatgagtgttgatgggattaattgtgtggatgttttagatttaaaatttaaattggaggaggagttgccaaaatatcagattcctttaaagaacattggtggagttgctttatacttaattcacgactgggatgctgtggaaagatttaacttcaaaaagaaggatattgaagacttacttaaaaaaattgcactcatagaaccaataaaagaaattttaaaggataaaaatgtagatgttagcaaattagagaaatttggtaaggttaaaaaagagaaaactaagaagtttttagatttattgagtggattataagcttaaaatggacattaattgctcctgaaaggagcaacttaatggacggggagtatcccaataggggtttcccctatggactaagaggtttttagatttattgagtggattgtagctccttaacagtaactaatgggattaattcaacattctctttttgtaggttttctttagctccttctaacctatcaacaacaacaaaaactttatcaacaattccaccattttccctaatctctttaactgcctttagcacacttcctccagttgtagtaacatcctccacaataacaaccttatctccttcttttagctctccttctatcttatttttagttccgtaatccttaggtttctttctaacaattaatagtggtttttgagcaataattgagacagctgtagctatagggacagaaccaagctctactccagcaacttttacatcttcatcctttatttgctcagcaataatttctccaactaactttaaaatttctgggtttgtggtggctttttttatgtctatgtagtagttactttttttaccagaggctaagataaattctccaaatcttatacaaccaacctcttttagcaggtttattaatttggattttttgtccataatatcaccaaattgtatatactctgctctttaagatttgtttaattcttttaaaaaagtttctataattctgtagcttaagataaaaaaagttttgtctatttaatatcttactattaaggttaaaaattattcttactttcaaatttataattttcagctttaaaagatataaaatcccgttttatacttctaagaggctgattttaatcaatagaaatttatgaaaaagagataaaaccctattgtttccattccaaatcggtctgattttaatcactaaaaataataatctatctaatttccattctccaagaggtcttattttaatacaagagcttacagagttagtgtatgtaaatcaaatgactataatttccactccgaaacggtcttattttaattctcacattgaagtttttggaaccatacatgagaccagataacgaatttccattccgaaacggtcttattttaattacttttgataacgctggagaggttagagattttatgtttccattccgaaacggtcttattttaattaacctttcctaaagtttatttcttctaattccacactcaagtttccattccgaaacggtcttattttaatgatgtaatgtagttattgaaaagaaaaatggagaatactatgtatcgtttccattccgaaacggtcttattttaattctccaaatcctctaaaaaatcatctacaaagtagttgtttccattccgaaacggtcttattttaattatagtattaaccgtaaaaaacataaacgggtgataaaatagtttccattccgaaacggtcttattttaataatttgcattatttttaacgcttacaatggacacaagtttccattccgaaacggtcttattttaatgggacaacaccctgtaagatttgtccaagaaaaacttctgtttccattccgaaacggtcttattttaatgtatggattcattatatgtttatgttgggaaatgcccaaattggtttccattccgaaacggtcttatattttgtcaatatcaaagaagaactcatccaaatctttaacaaaaattggtttccattccgaaacggtcttatagggcaatcattcacaacataatatacttcaactctcctaatatttaagcttttctacaccacatttttctaagggtaagtaactactccataatataaaccctttagtatttaaatcttcctttccataataaaactgagtatttttatctccttaaattcaaaaatttaacttgtctgttagagaaatcttatttcctttactaattaatcttaatttttaaaaatctgaataattcaataaactcaaatattctaaataatcaaaccagctaacccttagaaattaaatttaaaacctctaaataaataaataattcctaaatactctcatttctaaattccaaacttatacaacaagacaatcaataaatcaattaacaaaattgaaaatcctaaaaccctaataatgtaatgatagaataacgatagaatattattaaacaaactataattaaaattatctacagactcgtatataaacattttgtgataataaagctttattaagtcaattatcctattattacaactaattattacaactaagataaaaaatactgctggtgataggatgccaacaataaatgtaaaaaaagctgatttagagagattggttaatatgcccttagaggatgaatttattgaagagaaatttccaatgatgggtgttgaagttgaaggaatctttgaagaagatggagaaaaaattattcagttctcaataaacccaaatagaccagattatttaagtgctgaaggtttagcaagaggttttaggggaattattggaatagaaacaggattaaaaaaatacgacattgagagttcagatgtaaaattatatgttgagaatgttgaaacaagaccatacatagcaatggctttggttaaaggggttattgttgatgattatgttttagagagcataattaaccttcaagaaaagctccactgggttatgggaagagataggaaaaaagtggcaataggaattcatgatgcagataaagttaagcctccattctactacaaagaagttagtggggatgggattaagtttgttccattaaattcagatgaggaaatgacaccaagagagattttagaaaaacatgaaaaaggaataaaatatgctcatttaatcaaagatgataagtttccaataatattagatagtgaaggggatgttttatctatgccaccaataattaatggggaattaacaagagttacaactgaaacaaggaatttattgattgatgttactggaactgataaatatgcagtagaaaaaactctaaatattattgttactgcattggcagagagaaagtatggaaaaatacatgctgttgaagtaattaaagacaatcaaagcactatatatccaaatttaaaagaggatgtcttagaaactacttctgaatacataaacaaggttttaggagccaatctaactcctgggactataataaactacttaagaagatgtagattagacgctcaatttgtagataacaaaataaaggttttcatccctgcctatagagttgatatctttggagagattgacatcgctgaagaagtagctattgcttacggatataataagttctctggagaatatccaattattggaactattggggaacttaaccaattagaaaagaaatgtgactttataagagaaattatggttggatttggattctatgaggttataaatttaatgctttcaaatgatgaggttttatttaaaaagatgagaattgaagacaacaactatatagaagttttaaaaccagcatctatagagcatagaatcgttagaaaaagtatcttaccattgctaatggaaactttgaggataaataaacataaagagttgccacaaaagatttttgagattggagattgtgttgttattgatgaaaatgctgaaacaaaatcaagagttgttaaaaaaatagctggagttattgtagataatgaaacaaactttaatgagataaagagctatgttgaaggtttattgagagagcttaaaattgagtatgagcttgataattttgaacatccatcattcattaaaggaagatgtgctaaaatattgaaagatggcaaaattattggctactttggagagattcatccagaggttattaccaactttgaattagaattcccagttgttggatttgagttagagattgaataatgataaaagaggatgaaactctttgacctacttcagtaaaataaaatttttaaaaatttttaaggaatttcctaaattctaaatatatgaaattttttgtggtgttcgttatggcagtggcatatagtaaattatacgaacttattaaaaatgttaaggatgaaaaagaagctgaagaactctgcaaaataattgaagaattctttgaaaagcagtgtaaagagaatgtatctaaaaaatttgaagaacaaaaaccagttttaaagttagaacttaaagaagaattgagaaaagaattgacaacaaaagaagatttggaattaatcggggaaaaaattttaagatatgttgataataaaatcaaccaagttattgaaaaaatcaatcaattagataagaaaattgatgagggattttatcaattggataaaaaagttgatactctaaaaagagatattataattattgcacttataataatattagccaattatgccccaagcatcattggaaaaattctatcctttttaaaataagctttttaagtgaaaacatgcttaaaaatctactatataaaattgaaaagttaagaagtggagaattagaaggatttgaagttttaaaagagcatatccaaagcttggatgagtttcaatatcaacaaatagttgagagattaaagtttcaaattgagcttgttgaaaaatacaaaccaaaggttaggccggcaatagacccaatggtttcaacagaacttggtatctataggagattggatgattttgaaattggaaagcttttggattatccagaatgctgtataaaatcttttgttgaagatgttagagtagcaatagacagagagcatttaaaagaagttgaagaaatgaaggaggagttaaaaaataaaggaatttatgcaatagttttaccttctggtttcattccttgcagtttaaaatgtgaagaagcgataaaaagagggtttattggatatctaactaaagaggagtttgacaagatattagagcttgaaaaagaactgaaagaaaaaattagacattggcactttggatatgatgaatattatgagaagataatacttccgtaggggcataaccccatattggttacttcaaatctctattaaagtggggttgcctttggcaaccccgctcttgggtataccacaggactttcacaggaataaatttcttattgaacataatgatgctatagacatcataattccttatattgaattataaaactgtgaaagtcctgtgccaatagggcgaagccctatggtgatgaatattatgaaaaaataatcctataattaaagttttttggtgtcaaactatgtatataataatagctgggattggtagagttggttatacattagctaaatctctatctgaaaaaggacacgacattgttttaattgacatagataaagatatctgcaaaaaagcatctgcagagattgatgctttagtgattaatggagactgcacaaagataaaaacattggaggatgctggaatagaggatgcagatatgtatatagcagttactggaaaggaggaagttaatttaatgagttcattattagcaaagagttatgggattaataaaaccattgcaaggatttcagaaattgagtataaggatgtttttgaacggttaggagttgatgtagttgtgtctcctgagcttatagctgccaattatatagaaaagcttatagaaagacctggaatcttagatttggctattgtaggtagaggagaagcagagattttagaattcataattcctgaaaaagctaaggtagttaataaaaagattaaagaacttggaagacctcaagattatttgataatagccatatatgatggggatgagctgaaaattcctagtggagatactgaactaaaatctggagatagggttttagttttagttaagaaagatgccgctgatgctataagaaagatgtttttagaggaataaaattaaaaatgagggaaatcatgaaagttagagtgaaagctccctgcacatcagcaaatttaggagttggttttgatgtgtttggtttatgtttaaaagaaccttatgatgttatagaggttgaagcaatagatgataaagagattattattgaagtagatgataaaaacatccctacagacccagataaaaatgttgcaggaattgtagcaaaaaagatgatagatgattttaatattggtaaaggagttaaaataacaataaaaaaaggtgttaaagctggtagtggtttgggaagttcagcagcttcatcagcaggaactgcttatgctataaatgagctatttaagcttaatttagataagttaaagttggtggattatgcttcttatggagaacttgcctcttccggagctaaacacgctgataatgtagctccagctatatttggaggctttacgatggtaaccaattatgagccattggaagttttacatataccaatagattttaagcttgatattttaatagctatcccaaacatctcaataaacacaaaagaagcaagagagatattgccaaaagctgttggactaaaagatttagtaaataacgttggaaaggcctgtggaatggtttatgccctatataataaagataaatcattatttggaagatatatgatgtctgacaaggttatagagccagttagaggaaaactcatcccaaattatttcaaaattaaagaagaagttaaagacaaagtttatggcataacaataagtggttctggcccttcaataattgcatttccaaaagaagaatttattgatgaggttgaaaatattttgagagattattatgaaaatacaataagaacagaagttggtaaaggagttgaagttgtttaattttggataaggtatatatacttaaaattatatatattaaaatgcggtaagacaattataaaacgttaatttgaggataatatgaggctcaaaaagagatttaaaaaatttttcatcagcagaaaagaatatgaaaagattgaggaaattttagatattggcttggctaaagctatggaggaaacaaaagatgatgaattattgacttatgatgaaataaaggaattattgggagataaatgaaagtgttatttgctaaaacatttgttaaggatttaaagcatgttccagggcatataagaaaaagaataaagctaataattgaagaatgtcaaaattctaactcattaaatgatttaaagttagatattaagaaaataaagggctatcacaattattataggattagagtaggaaattatagaataggtattgaggttaatggagatacgattatttttagaagagtattgcatagaaaaagcatatatgattatttcccataattttatcttatctccctttataaattccttcataaactcctttaacatctctacactcaacaaaaacaatctgggcaattcttgcatatttgtagatggttattggattaaaaacttgcattaaatattctggtcttccttcatagccagggtcgtgaactgcagagtataaagttgcccccattcttagcagagaactccttggatatgcaaagccagctacattttctgggatttttatataatcagctacctttacaatataaactcctctatctaattttatgtgttcatctttttcagagttgaatatctctatgtagtttggtagctttcttttctcatttgagaaatcaataaccccttctccctctattttaaatatcttccaaactctcaaatctatcccacattgttgaatctgctcctcttctaaattatcaaaaaagttttttgatgtattagctcctataatcattaatttcaccaccatagggctctgccctattggtatacccgggatacattaagaaggggcttacagccccttttaatgtctcttggagatataccaatatagggcataacactcttctatttcaattttctaaatatcagctcatctcttttataaacaaatgtattactttctatatctctatcaattaaacaacttgccccaatccagcagttacttccaactttaacccctggcataaaagagacttgaatacctgttttaacattatctcccattataactcccaattttctaacgctctcaacccttttactctttatattgactttaactggtttatcatcaaatcttaagttggcagttattgtattgcaaccaaaattgcagttctctccaattatactatctccaacataagatagatgtggaatttttgtatttttcataattatacttgccttaacttcagatgaatttccaacaaaagtattttccattaaaacagtatatggtcttatataagctaacggccccacaacagccccttttttaataattgcaggcccttcaataactgaatttgctttaacaattgctccctcttctattataacctctcctttaataacaacattttcttcaattttccccttgatatctgtatttattttatccaggagatatttatttgcctccaaaatgtcccatggtcttccaacatcgttccaataaccatttaacttaattcctttaactttttcttctttaataagatgttttattgcatctgtaagttctctctctcctctttcagaaatctttgttttttcaattaattcaaaaatctttttgtcaaatttgtatattccggcatttattaaatttgattttgggttttctggcttttcttggagttctataatattattttcatcatctaaaactacaactccaaagttttctggattttttacctctttaacagcaacagcatatttgtattttaaaaattcttctaagtcatcttcaaagataatatccccatttataactaaaaattcatcatctacataatccttggctgttaaaactgcctgtccagttccatctatttctccctgctctaaaaatttgatttttggatggtttttaaaataatcaacaatcttttcttttttatacttaacaattaagtaaatattatctaccaaatcctcaactttttcaataatatgttgtaaaattggctttccagctataggaatcattggttttggtctgttctctgttagaggtcttaatctctcccctttccctgcacataatattatggcatccatttatatcaccaaaatttaaaaatagttttataaagcacttaaagcttctttaactaactttatccctttttctaacaactctttagcatctttgttattttttgcctcaactctaacccttatgtatggctcagttcccgaaggtcttattaaaacccatccattctctaagttaaatcttgctccatcaacggtctcaggaactgttttaaataaactctctccattttcaataacataactcattactttttcttttttatcatcttcacatggaatcttctcccttaaatttacataagatgggatttcatccaatatttcatataattttttgttatagaaatctaacatctctaaaactctcagcccactcaaaattccatctggagttagatggatatcagcatgaatccacgttccacttggctctccaccaaaaacagcagagtttttaatcatctcttcagcaaccgccacatccccaacttttgttcttattatctcaacatctaaatcttttaaatactcatcaataatcattgaagcatcaactgttgtaacaatctttttgtttccagttttttcaaccatatatcttgagaaagcagctaatagcttatcaaaatcagctaatcttcccttttcatctattgctaccattctatctgcatctccatcgtgtgctatgccaatgtagttatctccactcatatttaggcctttaatcatatccatagtttttttgaggtttttttcatctggctctggtaatctaccaataaatctcccatccatgtgactattaactgagataacatgacatcctaaatctgtaaataaatatggagatactaaacaagcagaggcgtttgcacaatcaataaccacattaaatttttcatttatctcaacatttttaagaatatgttccatatagttccttatcgccctgctatcttcccaaatctcgccaacactatgccactcaacttcaataaaatcttctttaaatataatctcctctatctcatcctcttcttttttattaaaagctaaaccatttttattgaagagctttattccattgtattctggagggttgtgagaggcagtaatcattatgccaacatcataatttcgtgcattaaaacctaaaactggtgttgggactatgtttatagttgtaacttcccccccaccatttaagattcctgctgttaatgcagtttcaattaattttcctgtagtccttgtatctctcccaactacaactttcttatatttttttgccactgctaatccaactttataggcaatttttggagataaatttttcattcttattccagaagtcccaaataatcttcccatttaatcacctttgctataatcattaaagataataatcaaaacattttgtaataattgaggtattaatgaacgccttctataagaagacgttcaagtgttccttattaattttaatacttttgaaagacattaaaattttaaaacattaagtttttatatatattgtcattaatcatttttgaaatcaatatcatgggtgtaatgtatgatactattagtaagccctatagatgttgaagaagcaaaagaggcaatagctggaggagcagacattatagatgtgaaaaacccaaaagaaggttctttaggagctaactttccatggatgattaaggcaattagggaagtgacaccaaaagatttattggtgagtgctacagttggagacgtcccttataagccaggaacaatttctttagctgctgttggagcagcaataagtggagctgactatataaaagttggattgtatggagttaaaaactactatcaggcagttgagttaatgaaaaatgttgttagagctgttaaggatattgatgaaaataagatagttgtagcagctggttatgctgatgcctatagagttggagctgttgagccattaatagtcccaaaaattgcgagagatgcaggttgtgatgttgcaatgttagatactgcaataaaggatggaaaaacattatttgatttccaaagtaaagagattttagcagagtttgttgatgaagctcacagctatggattgaagtgtgctttggctggttcaataaaaaaagaacacatcccaattttaaaagagattggaactgacatagttggtgttagaggagcagcttgtaaaggaggggatagaaataacggcaggatagatagagagttagttaaagagttaaaggagctttgtaagtaaatttttataatttttaattttgttttctttttataatgttagggaaattttattaagtatgattgagtatcaatagaaaagaagtataaaagaacaaaaattgcttattaataggcgtagaaatgataaagcccgggtcgcctagccagatagcatgggcgagatgatgaatatgttgcatccatataagaagaataaaaaaagaatgggttattccttatggttggttgtatgaaaagtatattgttgaaggtctgagtgatagggaaattgcatatttgattggttgtggtaaggcaacagttgtgcgagcaaggcaaaagcatggtatatatagggaagatgtaaaaatgtgtgatgattatactttagataacatttctgaagatttgcgtacatttatcgatggattgttacttggtgacgcatgtattacggaaaaaggaaacttattgattacacagaataagcgatatgattggttagaatatgtcaaacatcgattccaacaatttgggcttaatgtatattttcactgttataagtataagcgtagaacttctgaggtaattgctgatttatatgttttatcaacgagtaggtatgaattgtttaggcaattaagggaaagatggtatccagatggaataaaaaggataccgaatgatttggtaataaatgatgaaggattagcacagtggtatcttggtgatggaagcttaacaaaacagaaaaatggttataagttagaattatctacacatggctttacattggatgaaaataagtttttgcaacaaaaactaaaattattgtatggatttgattttcgtatttcaaagaaacatcaatacagatatttgaggttatttaaaagtaagcaagtgcatgctttttgtagtatagttgaaccatttataccaccttcatataggaataaagtaagatgtttacatgattaccaatggttgaaatcatgggatgtaatatagagcccgggtcgcctagccaggatagggcgctggcctgcggagccagttttttcaggggttcaaatcccctcccgggcgttatttttattttatcatataaagaattgggtgaaaataatgtttttaggtaatgacacagtagagataaaggatggaagattcttcatagatgggtatgatgcaattgaattagcagagaagtttggaacccccttatatgtgatgtcagaagagcaaataaagataaattacaacagatacattgaagctttcaaaagatgggaagaagagactgggaaggagtttattgttgcctatgcatataaagcaaatgcaaacttagctataacaagattgttagctaaacttggctgtggagcagatgttgttagtggaggagagttgtatatagcaaagctatcaaacgttccttcaaagaaaattgttttcaacggaaattgtaaaacaaaagaagaaattataatgggtattgaagcaaatataagggctttcaatgttgatagtataagcgaattaatcttaataaatgagacagcaaaagagttgggagaaactgctaatgtagctttcagaataaaccctaatgtcaatccaaagacacatccaaagatttcaactggtttaaagaaaaacaagtttggtttggatgttgaatcaggaattgcaatgaaagcaataaaaatggctttagagatggagtatgtgaatgttgttggagttcattgccacattggttctcaattaacagatataagcccatttattgaagaaacaaggaaagttatggattttgttgttgaattaaaagaagagggcattgagattgaagatgtcaatttagggggaggtttaggaattccctactacaaagataaacaaatccctactcaaaaagatttagctgatgcaataataaacacaatgttaaaatacaaagataaagtagagatgccaaatctcatcttagagcctggaagaagtttggtagctactgctggctatctattaggaaaagttcatcacataaaagaaacaccagtaacaaaatgggttatgatcgatgctggaatgaatgacatgatgagaccggcaatgtatgaggcatatcatcatataataaactgcaaagttaagaatgaaaaagaggttgtaagcatagcaggaggtttatgtgagagtagtgatgtttttggtagagatagagagcttgacaaagtagaggttggtgatgtattggctatatttgatgttggagcttatggaattagtatggctaacaactataacgcaagaggaagaccaagaatggttttaacaagtaagaagggagtattcttaattagagagagggaaacttatgctgatttaattgctaaggatatagttccaccacatttattgtaatccaatctttaattttttatctattcttttattttttaaactgaaaatattataaagagcatctattagatttaaaaggaatccatctaaaatcctgtttttttacaaaaagtttattaaaaactaataaaatctaaacgccttcctatagaagccattcattatattcctcttactataaggttcgttcaaaggttttataaaaaatcttaaattatacattgagaattataattaagttaagtctggaaatattattaatattaattaggatatttattcccaaagaaaatcctaataataaaaagaaaattggtgaaaggatgaaagaagttgctataattggggctactggctatactggggcagagttattgagattattagcaaatcatgaaaaagttaatgtaacatatataacctcaagaaaagaagctggaaagcatgtttttaaagttcatcctcatttaaaaggtattgaaaagtataaaaacctatgttttactggagatattgataaggttgatgcttatttggtatttactgcaactccacacggagcttcaatggatatagttccagattttattgagagagggatgaaagttattgacttaagtggagattatagatttgaggatttaagcttgtatgaaaaatactataagataaaacataaaggattacctgatgtaaaaattgcttatggattgccagaattacatagagaggaaataaaagaagctcaacttgtagcaaatcctggatgtttcccaactggagctattttggcagtagctccattagttaaagagaatattatagaggaaaggattatatttgattcaaaaacgggagttagtggagctggaataaagccaacggaaacaacccacttcccaaatgtaaatgaaaatataaacccatacaaaataacaacccacagacacactccagagattgagaaggagttaaaaaagcttggaaaggctaaggtttcattcactcctcacttagctccaataacaagaggaattttaacaactgcacacacattcttagctaaagatgttgatagagaggagataattaagatttatgaaaaattctatgggagtgaggtttttgttaggatattttcagaagagattccaaaattaacatgggttagaggaacaaacttctgtgatatcggaggatttgagattgatgagcatggtagattggtagttatctcagcaatagataatttagttaaaggagcgagtgggcaagcaatacaaaacatgaatataatgtttggatttgatgaaaaagaggggttatttgatgtagggttaaatccataattatttttaatattttttggcgatgtattaagtatattttatcttcaatattaagaaaataactcctattttataattgctaccactacaacaagtttccattccgaatcggtctgattttaatcatctggatataattcctctaataatctctcaattttatttccattccgaaacggtctgattttaatcctctccagaggaggcggagaaggttaaaaaataaagtttccatcctccaagaggtctgattttaacatgaaattaagagctgaacataaattgaaaatcagaatatttccatcctccaagaggtctgattttaacaaataaaggaataaacaaatctgcattacctacaactgtagaaaaaatttccatcctccaagaggtctgattttaactgaattccacgccccaccctcttaatttcaaagacccccatttccatcctccaagaggtctgattttaacatattcatagaagaacttaaaaaaacaggattcaaatttccatcctccaagaggtctgattttaactaaatttaaatctatcgatatacaactgtaaaaaagatttccatcctcaaagaggtctgattttaacatttgatgaaacggaatattcacggtttgaatatactgttaaatttccatcctccaagaggtctgattttaacatttaattgaaaaatatagtgatgaatttttatatgaatttccatcctccaagaggtctgattttaaccatctttcattgcttttctctcagcatctccccaagcagtatttccatcctccaagaggtctgattttaactcaataaatagcactaaaaacgagattttattctttatttccatcctccaagaggtctgattttaacaaataactctctaactatatctgataataaaaagctcatttccatcctccaagaggtctgattttaactaggtttaaaaagggttgattatttgaaagagaaatataaaggatttccatcctccaagaggtctgattttaacagggcaatcattcacaacataatatacttcatcactcttaatatttaagcttttctataccatatttttctaaggataaataaccatcttacaatataaaccttttagtatttaaaattttatctctttactaaaacagagtatttttatctccttaaattcaaaaatttaacttgtctgttagagaaatcttatttacttacctaattaatcctaatttttaaaaatctgaataattcaataaactcaaatattttaaacaatcaaaccagctaacccttagaaattaaataaaaatcctttgaactaattaataaattctaaatactcttattttcaaaatccaaacatattcaacaagacaatccattaaccaaacaacaaaattaaaaatcctaaaacccaaataataaattataaacagacttctataagtaatttgccacacttcgtaataacttaaaggtggttatgatgtttattggcattgatgatacagacagcccaaataaatactgcactacttatatagcgacattattaatagaggagttaaaaggttgtggctatagcgtagatatgccaaaactcatcagaatgaatccaatggtcaaatataagacaagaggtaacggaggagtggcaatacatatattagatgagttatattcaaaagataaagaggagattaaaaatataaccattagtttggttgagaaatatacagattttgaatgtgaaaatacaaacccaggcattgtatttttagacgaagcaaaatacaaagaaaatagagaaaaacttaccaactattacaaaaaagttctttatgacatagttagcgttgattatgctgaaaaatttatcttaaaagttggaggggagtttataaaatataagttagggaggggtataattggagctttgggggctatatcatcaactcccccatacacatatgagcttttagcttatagaaaaaaagagatgtggggaaaaaagagagagattgatgaaaaaagtgtcatagaaatggataaggaaacttttccttatacctttgacaactatgattatgagaatgaaaaaatcttaatagctccaaacacaccatgccctgttttatttggaattagaggaattgatgctgaaatcctattaaaggccatgcataaaattgaaggagaaaaacctgaaagatttatgatttttaaaacaaatcatggaaccgacgtgcatttaaggaagatgaatattaaagacatctacccaaacactggagttattgtttatggaagagttgtagaggagccgagagatatagagggaggacatgtaatatttaaactctcagatggaactggagaaatcgattgtatggcttatgaaccaacaaaaggatttagagatattataagaaagctgatagttggtgattacatagctgtttatggaactgtgagggagaagccattagggataaatattgaaaaaataaaaatcttaaagttggagaagaaatttgttaaagataagagatgcccatactgtggaggcacgttaaaagcaaagggtaaaaaagctggatacaaatgcaaaaaatgtaaaaaaactattgcctatgatgaaattaaaatgatagaggttgagagagatttaaaaactggattttatgaagtgcctggctctgcacgaaggcatttaagtaagccaatacagttaatagatttaatttaattaaataatttaaaaatcttagaggtttttagtatggatataaaatataaattagcaagttatagaatttgctccccagaagagacatttgaaaaaattcaagaggcattgaaaaagattgagacagtagaaattaaaaatatacagcatttagataaagtaaatatccctgtctattatttaaaaaggagagttgttgtagatgggaaagagggaatagccatacactatggaaagggggctaatgatatccaggcaaaggtctctgcatgcatggaggcgatagagaggttttcagcaagttatgataaaaataaagttaaagaaaagccagataatccaataaatgttgaagatttaatattgccccaatatgcagataaaaatgttaaagaatgggttgaagggattgatatcataaataatgaaactatagatgtcccagcagacgctgttttctacccaacatctggaaaattatttagaggcaacactaacggcttagcaagtggaaacaacttagatgaggcaattttacatgctactctggagattattgaaagggatgcatggagtttggcagatttagcaagaaaaatcccaacaaagataaatcctgaagatgcaaaaaacccattaatccatgaattgattgagaaatatgaaaaagctggtgttaagataattttaaaggatttaacatcagagtttgagattccagttgttgctgcaataagtgatgatttaagtaaaaaccctctaatgctgtgtgttggtgttggatgccacttacatccagagatagctattttgagagctttgactgaagtggctcaaagtagagcctctcaattacacgggtttaggagagacgctaaattgagagaagaatttacatcaaaaattccttatgagagattgaaaagaatacatagaaagtggtttgagtttgagggggagataaatattgcagatatgccaaacaatgcaagatatgatttaaagaaggatttaaagtttataaaagataaactttcagaatttggatttgataaattgatatatgtagatttaaataaggttggggtagatgctgtaagagtaataatcccaaaaatggaagtttacaccatagatagggatagattatcaagaagagcttttgaaagggttaaaaagctttattattaaaattttagtatatttcaaaatattttggattaagtatggacttaatgaacgccttcttatagaagacgttcaaattttcattattatttttaattacttttgaaagacactaattaatgagaaaagtgctttaattcaaaaacattgagttttttgtttttttctttaaagaactcttctaatattttcctctcttttattaaaccaactgcatcagctctgcactgcccacaagctctaaactgtggaatgtatttttcacattcctctctaactttttttagctcttcacatgttggaggtcttaaatggctcattttatatagggggattagagggatgatattttgtatataaacaaaatccttcaactctttagctatatctaccacatgattcatatttatctctggaattaagacggtattaatctttattattaaatcttcatcataagctttttttatcccatctatttgattctctatcaatatctttgccccttcaatcccataatggacttttttatcataataaacccattcaactatttccttcaaaatctctgggtctatagcattcacagttacagtaactgtctttacatttaaatcagccaattttttatagtatttatttaaaagcaaaccgtttgtagagaggcattttataaggtttgggaacttttcatcaataatttttaaggtctcaaatgtctctttattaaataaactatctccaggtccagcaataccaacaaccttaatgtttggaatctctttcaacaccttgtttaaataactttcaacatcttctggttttaatactgataaagccacacctggtctatgctcacatgcttctttgcccaaactccttctgcagaacttacatgcaatattacatcttggagcaactgggagatgaacccttccaactttatcgtgaattttttcgttaaagcagggatgaacttttgttatatgggcaaattttgacattttatttttgtccataatatcactgcataaattttcattttttgaacattactaaattggaaaaggacatatattaatctatgcaatttctaatatacatttgaatatacaaatttgtatttctaaaataaaaaatagataaacaattaaacaatcgcatgttcaagaattggatgggctatagtatataatccaatcaatattataatgctgccacttattagaggaagttttgatacttttctatttccaacatattttttaatcaattccttactttcaacaaaggcaactgctaagccagttaatgagattgccagcccaatgctaaatatcgcaacataaattaagccatcaattaaatttcctgatgatattgataataataaaaccgctaaagctgctgggcatggaactaagccagcagataatcctaaagtgataactcccttttttgtatctactttatgttcatgtgggtgaagataacttcttattatccaaattcctacggcaattaatattaaacctccaacaacgctcatcatatcatgaactacatcaacatttaagctctccaataaataaattgataagattcctaataaaaatattactgctgtgtgggatatggttattgtagttcctaataggatggcatcttttaaatctgctttagttcccaatatataggcggcaacaacactttttccatgtcctggctctaaagcatgcaacattccgagtatgaatgcagtgattgcgtataaaagttccataatcatcaccataataactactttttatatatctttatttttagtaatacttaatattacctaagttgccttactatttaaatagtttattactaaaaaagaaaaattaatcattattaaaaatgtctttaatttaaataagtaataaaaaatatgaaaaaaacaaaataactcattaatagtaacaaaattaaagtttattttattaataataaaataccgttaaatttatataagataaagagtactataaatgtgttaagtttttttgaattatattcaggggtgataacttgcacataatggagggatatctcccaccaatgtggtgtgcagtttggtgggttctctcaggtattgtaattgcctacggtattgttaaattaaaaaaactacttgaagaaagtccagaaatgaagccattagttgcaatatctggggcatacatgtttatattgagttccttaaagatgccatcagttactggaagttgttctcacccatgtggtaacggtttaggggcagtgttattcggtgttccaataactgctgtgttagcggctattgttctattgttccaagcgttattcttagctcatggaggtttaacaacacttggagctaacgatttctcaatgggtattgttggacctgccgccgcagtgattgtatatagattatgtatgaaggcaggtttaagctctacagttggaatattcttcgcggcattgtttggagactggctaacttatgtcacaactgctgttcagttagcacttgcattcccaatcccttcattcacagcggcatttacaaaattcattgtaatttatgcatatacacaagttccattggcaattgcagaaggtatattgacagttataatatgggactacattaagaaattaagacctgacttattgttgaagttaggagtagttccagaagaggagttaaaaccatatttaaccccctctcctgcaggaggtgagtaaatggaaacaaaacatataattttattggcaatagttgcaataattattgccttacctttaataatctatgcaggtaaaggtgaagaagaaggatactttggtggttctgacgaccagggttgtgaagttgtggaggaattaggatataaaccatggttccatccaatatgggaaccaccaagcggagaaattgaaagtttattgtttgctttacaagcagctattggagcaataattatcggttactatatcggctattacaacgcaaaaagacaagtagctgcttaattctttaattttttacttttttaaattttaaaatttaaaggtgggttttatgaagcataacattgttgataatgttgcttttagtaacaaattgaggcatgttaatccaaaattaaaggttatatttgccctatctttacttttaatatctgttttttcaacttcgtttatagttccattaataatattttttataaattcaatactactactgtttaaagcaaaagtcccaaagaagatttatgccgtgtttgtaggtattcctcttggattcggtatattaaatttagtaatatttgcatttttatttgggacagttgaatggtttaaaataaatgtttttggctttgaaattcctgtgtataaagatgggattgaattaggacttttattatttggaagaatgcttggtggagttagtagcatgttatttttggcttttacaacaccaatggttgaattattttatatatttagagagttgaagatgcccgatgttttagttgatatgatgatgcttatatatagatacatctttgttttatatgaagaatatgaaaagatgaaatttgctcaggaatcaagattaggaacctcaaacttaaaatcaacatacaaatctcttggtgccttagccgctcatttgtttattagagcatgggaaaagggagaaaaactaaatattacaatgatgtcaagatgttatgatggaaaaataaagttattgcaaacaattgaaaatccctcaattaaatatatcttattcattgcaatattcgatatatttttaataatattggcttatttaacaaaggactttacactaacatcatacataaaaatttaggtggaataaatgtatatagttgaaacaaaggatttatattttagatatcctgatggaacagcggttttaaaaggaataaattttaaagtaaaaaaaggagaaatggtctctttactcggccctaatggagctggaaaatcaaccttatttttacacttcaatggaattctaagacctacaaaaggagaggttttaataaaaggcaagccaataaaatatgataaaaaaagcttggtggaagttagaaagacggttggattggtgtttcagaatcccgatgatcagatattcgcccctacagttaaggaggacgtggcatttggacctttaaatcttggcttgcctaaagaagaagttgagaagagagttaaagaggcgttaaaagctgtaggaatggaaggttttgaaaataaacctcctcatcatttaagtggaggacaaaaaaagagagtggctatagcaggtattttagctatgcagcctgaggttattgttttggatgaaccaacagctggcttagaccctgttggagcatcaaaaataatgaaacttctatacgatttgaataaaaagggcatgaccataataatctcaacgcatgatgtagatttagttcctgtctatgctgacaaagtttatgttatgtatgatggaaaaattttgaaggagggaacaccaaaagaagtttttagcgatgttgagactataagaaaggcaaatttaagattaccaagggtagctcatttaattgaaattttaaataaaaaggataatattccaattgaatggggatttacaattggagaggttaggaggaatattgtaaattatctaaaagagaaatgttaatttaattcatcattctgcagttaaaaatccttacatcttctttatttagttcttttaaaagctctttctctttttcttcattaactaagattattacacatcctccccctccagctccagttaattttgccccaaaaccaaatctattcccaatatctacaattctatcaagttttggtgttgagatatttagcttttttaacaactcgtggtttttagtcatcaatttcccaaaatcttctttatttttgatttttaaagcttcatcaataactttgtctatctctttaaatatctcatctttattttcaatcttggcaacttcattaactaactcagcagtttttttcttccttttttcagcataaacaattaaaaacttgcaattttttaaaaattcttcaaactctcctttaatttttctaaacttgttgttttttatttctaagatacctttatacgttattgtcgaagtgtctgtaatgcttgccttaccttggatttctttctcaaccatatatccaagttttgcaatctcatcatctttaagctctttattataaaatccacttacagcttttatagttccaattgttattgaggcagagcttcccaaaccacaacttattggaatttttgagctaatgttaattttaaaaccagtttttggctctatatttaaataatctaaagtgtttttaattgcacagaggcagtatttaaaatctccaaagttatttggattgatattttttatctcatttaagttcaaacctaagcttttattcaagtcatttaggtttaaaattatctcatcttcttgtgtttcttttatttctatggttgatgttaaatcaatagccatagatatagctctataaccataaacaactgcatgctctccgaatagtataacttttgatggtgtttcaattatcataacaagccctattttatctttttatttttatgtattcattaaacgcctctcttgtagttcctacaacaatcctcttatatctttctccacttttatcaataacctcctccaactttcctcttgctacaatctcctctccattaaagcactgcccagcataggtgtgagtgaaagaaacaacttcctttatatcttcatcattgtagcactctattttataaactgctggattatcaaaggcaaaatcatcatttaaaactcttccctctatttttgcaaatcctaagtttttatatctcttatctccatatttttcagttatctcatcccattcccttgtaaataataagtcaaacattgtgttatccacaattcctctgttatatttccttttttcatagaatacaaattcttcgtaggttaaagttttatctttaatcctttttttataggcaattttccaaaaatcatcagatagtggttttaacttattatcttcaaatgcctgctttaatgcttctcttgcttttttgtgcatatcttttccataaattacaaagtcaatatctgaatttttgttgtttaattttaacaataaagatccgctaactcccatgcttttaattggaactccataatcttccaatattagagctaatttcctacatttttcttctaattcatttaaattattttcttcgttaataatttcatttaatctttcttttggtcttaaaattcttttaacatcttcttttggaatagcatgcattaaaacattgattgtttcatcataatataagtatttgctaaatttttcctctaaaaacttataggcaattttgctttcagccatctttatatactttcttccattaatctctctaatgttattatcttctattttaaaatctacaaactcatatgggacatatcttaaaaatgcaaaaaatttattttttggatgggcataggtatttactgcaaaatataaaccttcagtcgtttctataaagtccctaattctaaccttcatgataccacatttgattttatcttttcaattctttttgtaacaacttcagtatatagctttctcaataactcaatatctaaattaatctctccattttcaactatgaatgggatgatatattctttaatatctttatagaacaattttgaatcttttattatgtagtctttaaatgaggcgttacttataactaaagcaccaaagtttttgatatattcaattatgagtttataagcttcatcttttgatttagaaactttaatattgcattcattggctaaaaatctacaaatgtcttttcctttgattttataatatgttactgtatccatcactgtgataatattcttaaatccagcatttttaatctttttgattagattttctatggagtttggtgaaagattgtgcatattatttaaaacacttatagcatctataataacaattcttcttgatggttttggtggataaattcttctaaatatcttttcctctttaatatattctccaagataagaaacaatctcactatctaccaaatattcttctaaatcatctactgttgtaaatcttgttgaataccatgaaggtgatgaaagattagcaagcttatttaatacatctttctttattttcattagtcgttctttttcttttagtttgttgtataattcttttaatgtaatttcttcatctatttttaaatccatcagaactttcaataaatatccttcttcaaatgtttctaatccaaagttttcacagattctttttaattccatatattcttcaagttcttttttgctattaacccctatagcttttgctatcttatattcatcagcatctctaaaccctttacttaatgcatcgttgtattcgtaggcatctttaaatcctctatttaaggcatctttatattcattagcgtctccaaaacctgcttttaacgcattttttaattcatcaaaatcactaaaacctttttctattgcaaagtaatatagttcagcatcatttgaaaattcccgattctccaaaattccataatataaatattctattatatatttatcgtccaatctttgtgcaattccttcttttacaagttcttcaagtcctccaataaaaccaaggtctttagcctttttatactcttctatagatttaaatccagatgatttgtattttttatattcgttgatatctccaaactctaagtattcataatactcctcagcacttaatcctaaagattttgcttcaattaaatcttccaatgttttgaatccatcagaaggaatataaaatataaccccattatcaacaaagaaaaatatgtcttctaaattatctttatatctgcaaattacgtgtttcccaaggactctatgcgcttcaagaaattcttcaacattcttaacttttacttttggtaactcttctatttcatccacatcaatatattttattaaatttgctcttatttttagtatatttttatctttacccatgttatccatcctctattaaatttattaaatatttttatttagttatcttatcaattattgcgtttttcataacttctatatttggttctacaccagtccatattttaaatgcaactgctccctgatatatcaacattcctaacccgtttattgtttttgcattaactttttttgcctctttcaataaaaccgtctccaatggattataaattaaatccataaccaccatatcctctctcaacttctctgctttaactattggttcaacatcaatattcggatacattcctattggagtagcgttaattattatatcaactccatctaaatccacatctaatccactgaatttaacttcttcaccaaatttcttatttaatttttctgctatttctttagctaatgcttcagctttttcaacggttctattggctattattatgttattatcttttgctaattcaaatgctacagctcttgcagcccctccagctccataaataactatatttttgtctttaactcttccaatttcttcctctaaagccatcctcgccccaataccatcagtattatagccgattgctttcccatcctctatttttatagtattaacagccccaattaattgagcatctttatctatctcatccaaatacttcataatctctattttatgagggattgttacattaaatccaactattccaagggctttagccccatctattacatactttaaattttctggcaacacatcaaatgcaacataaacataatttaatcctttatctttaaaagctgcattgtgcataattggtgagaaagaatgttctacaggatgtccaatcaacccaataacctttgttttagcatttatcatattatcacattaaattagtttttataattaaaaattgtaaattacaaagagaaggtaaaaaataaatatcaaataacacaaaagtgttttattttttaattaatttaacaacttcagctacctttttacctaagtttcttgctgtttctaatccaatgtcatcatttttacaatctccaggagcttttcctactccagttcctccataatgagctgttgggtcgttatcaccaacaactatcattgaatggattaagaaaaagttgtgtatctgttgaattgttgtttcttgcccaccatttctacttgctccaactgctacagctccaccaactttatttcttaattgaaatcctattcttaaaggtcttgacctgtccatcaacatctttaactgagctgaaactcctccgaaataaactggcgaaccaagaataattccatcagcttctttcatcttcttcaatatttcatcaacatcatcaattattgggcattttccttcctctttacacatattacatccgatacatggatttaattctttatcagctaatgagataaattctgtttcaattccttcctcagcaatagcatttaaagcctctctaactaatagggttgtatttccttcaggtcttggactaccacttatccctataactttcatactctctcacctatggacataaattctgacctaatgtattttatcagaaataggttttaatagtttttctcatttcctgttttctctaaaataggttagccattttttaacattctgataccaatcatccaacaactcttcaataatatcgctcaccctatccaaatcaacagcattatatatatacttatacccaactttctccgtcacttttcttctatcaactaaaccacaattcatcaaacttcttaaagctttctgaacagtagttctgtctctattaactctctcagctatctctaacacactaccctctccattttctaagaggtcaaaataaactcttatttcaatctcttgcaatcctaaaatacatctcattaaatcttcaattgtaaatttttttagtctatttataataaattctttcatgatatcacaatgaaataattatttatcacctattatcttcacataaaactctctccttctcggcccatcaaactctgcaaaaaatattccctgccaagttcctaataatggctttccatctttaataataattgtctgagaacagccaactaaagagctttttatatgtgcatctgaattcccttctaagtgtgtaaaattccaattttttggaataagatgagagagaaagtttataatatcatgctttactgatgggtctgcattttcatttatagttattccagcggttgtgtgaggaacatagataactgctattccatctttaacttttgattcggagattgctgatattatataaggagttatatctaccaattcctctcttttgttggtttttatttgatatttaaatagcatttttatcaccaacaagattttatatccgcaatacccaattaaatttttgatatgtttttgatttgatgtgataagaccttaattaaattttaaatattaaacttgaatagttataatttatagttataatttaataatttagaacatggagggaaagattatgaatatcaaacataagataccaattttattattggttttatatattgctcttggagtatttatacaatataatggaatctcagagtttaagtctttaccgtccccaatatatggtggagactactattatcagatgggtgttatttggcatattagagatggagggaatccattagagagctcttcaatgattggtggaatgccaggttatcttccattatatgcttatctctgtgctaaattttgtgatttactcaatttagatacaatgaaagggatactttatttctctgtagtgctatttattatgacgagtgttatatggttttatttgtttagagttttatttaaagatgattgggttgctttaattgaagtagttttagcataatgtactaaactatattgaatacttaaactataaatatggattattcttttataaagtcgttaaagagtgtagtaaagaactaataaaaaaggaatatcataatcacactgtcactaactttaaactttattattacattcatttttaattttaaaaaacttaaaacagagtgaaacaatgctaaatctcctatatttaatcttaggtataatctgcggaactataactggtttatttccaggcattcatccaaataatattgttgctttatcattcttaattttaccttattttggattagacaattatatcccatttttaattggtttggttattactcactactttataaattttatcccttctgcttttttaggagtccctgatgatgaaactgctgtttctgctttaccaatgcataaattaactttaaatggaaatggatatgaagctattgtattagctggatttggaagttatttaggagtagttttttcaatactcataagtttatttttaatgtcaattttgcattttgatgttagggcattttactgctcaattaaaatatttatcccttttattttaattgcctttattctatatcaaatttttacagcaaaatcagtttgggaggttttggttatatttctatcaggaatttttggaattgcagttttatattgcagtgaagcatttaatataaccttaacggcaatatttactgggatgtttggaattccactgcttataaataatttaaagacatacaaaataaaaagtcagatgatggcatttcctgattttgaattaaagtttttaaaatcatcattttttgcatctgtagctggattttttagaatatttttgcctggaataagtggagctcagttaaactatattttaagtaaaattttaaatgaaagggatttaaaaaactttatagtgtctcaagggagtattattttgtctaatgaggttttttccctattggcagttatttttattggagttggaagaagtggagttgcaagggcgatacaattactaaatgccaatattaatataaacacagcaatattttctattttgatatcttctacaatagccataattatcttgttaaatttatcaaaatatattcttcttttcattagaaaagttaattttaaatttttatcgttattttttattatcttctgctcacttgtagtaattattggaagctataacacttacttaatttatcatattattgtttatttaactgcaatttatatagggcttttagcagtgaaaagtaacactaatttatcaaatatgatgaacgtcttaatatttccaacgatattatattttttgaggggataagatggacttagagggacagattttaaataaaagaacaatagtttcttttgttatatcgttgggcataattttatacatattatcaaaaattgatttagataaattagtgttaattttaaaaaaacaaacattttttattattttttgcagtagtaatgttttatatctcaatcctaattaaaagttatcgttggaaaatctttttaaaaataccaacattgatttagaattaaaagatgcatttttaatatatttttaatatattatctttcaatgtttataaattcattagttcctgctaagttaggggatgtttatagaggatatctattaaaaaagaaaacaaatgaatcaatatctttaggagttggaactgttttcattgaaagagtttttgatttagtagctatgatttctcttctatttatctctgcctatttatcatttaaatcagatattccaaaggaaattctttattcaataaaatggggggttattataatcttattcttgattattttgatttttggttttttaatagttaatagtaagataaatttaaaaaataaaaaattagaggcaatattgatgaactttgaaaagggcttaaaagcggtgaaactaaatacccttcctttattaataactttatcatttactgggtggtttattgagggactaactgtctattttatatttctatcattaaatctaaatttagaaatcttatttggagtattttctgatttagcatcttcgttattaactgctatccctttaacaccttctggattaggggtcgttgaatatgcattaatttatatattaaaactaaaaaatatagattatagtggagcttttgcagtccttattttatatcgtttaatatcatatttctcaattgttttgtttggtgcgataatgttttatatcgttgaaagaaatattctaaaagaacctaaaaatgagaaatattaaattaaactgtatttctaaaaacacaataaaaaacataaatacctaattatcaattcaataaaaacaataagagtgttattggtgataaaatgaaactcacatttgatttagatgggaagataatatttagtaaagagttaagtgaggaggcaaaaaatgctgtagaggaagttttaaaaaatgcagacagcatattcttaaaaggtgttccaaagggtaaagaaaatgaggcatcaaaaataaaaagctatgagtttgaaggaaacattttaaaattaaaaattgcctctggaacttacacaagagctcatgaaggattaattagattgagaaagccgttagctgaaaaattgggaagaaactttagaattggagttagaggaattgagatagataattatgtaataacaattgaaacagatgaagataaagctaaaaaattagaaggcattaaagttccagagtgtgaggcaaaagttgaaggaaacaaaattatcttaacttttaaggacattggagagagtgaattaaaaagaaacattatagatagagcaataaagttcgtaaaaacagagttggagaaagaagaagaggatttaacattcaaagtttgtaaaattccacctggaacaatagttagtgaatataaggcaaagagaaaaataacatttgataaagacccaacagatgttgctgaaaaacttggatgggttaaaaaattcccaggaagaggacagtggttctatactccaccaataacagcattgtttagagctttagaggagttaatagttgaagaagttgttaaaaagattggatttcaagaatgcctattcccaaaactcattccattggagattatgtataagatgagatatttagagggcttaccagagggaatgtattacgtatgcccaccaaagagggagccagagctttttaaagagtttgtaaatgagatgatgattaaaaaagagattccaattgaaaaattaaaaaatctattgagagatccaggttatgtgttagccccagctcagtgtgagccgttctatcaattctttgagggagaggttattgatgttgataaaccaataatgttctttgatagaagtggatggacttatagatgggaaggaggaggggcaagaggtttagacagagttaatgaattcttgagggttgagtgtgtttggattggaagtccagagtttgttgaagaaacaagagacaaaacattaaaatatgctgaaaaattagctgaaaagcttgatttagagtattgggttgaggttggagatgacccattctatttggagggtagaaaaaaggaggatagaggaatagaattcccagacgtgccaaagtatgagatgaggttgtggttaccgcatataaaagatgagaggaagggagttgctgttacatcagcgaatgtgcatggaacacacttcgttgagggctttagaattaaagattataaaggaagaagagtttggactggttgtactggatatggaataacaagatgggttgttggttatttagctcaatatggatttaattttgatgactggcatccaataataaagaagaagattaaaaagcttccagaagttcctcaattgataacttggcctaagaaggatgaataaatttctttaattttttaaccttttggtgataatatgagattttataatagggagaaagaacttaactatctaaagaattatgttcaattagaaccaaactctatattatttgtttatggtcccaaatcatcaggtaaatctaccgtaatgatgagagttattaaagaattggaaaatagtaatattgtctttttctactacaatctaagaaaatatgcgacccccacaaaagatgagtttttgagtatattttttgaaaaatcagataaaaaatatctattaaataagttagaaattaatctgaaaatctttaagtttggtatagaggaaaattttgattttaacaacataaaactaaatgatgtttttgctaaaataaatgagagcataaatacagttataaaagatggaaaaaggcctgttttggtcatagatgaacttcaaaaattaaaaaatatttacttcaatagtggaaaatctttattaaacgaactatttaatttatttgtctctttaactaagatggaacatctatgccatgttatttgtttaacatctgatactttatttattgataatgtctatagaaactcttctctatcagaagcatcagagtattatctaatagactggctaaaaaaagatgatattaaaaaaatcctaaaagaagaaggatttaataaaaaagaaatagattattgcctaaattatttatcattaccttatgagatttctcaattaataaataataaaaaattaggattatcagttgaagaaactataaaacgatggataaatattgaagcggatgggataaaatatttaatagatacttccgatttaaatgaagaagagatttataaagtcctttctaaatttaaggataaaataaaaattaactataaaaaagatgttaaaaaagaggaaatgaaatatataaaatttttaattgaaaatgagattttgttttatgacgttattaatgggataattaagcctacatcggtaaagaaatggtatgccataaaagaaattttggataaataggtgatttaatgataattaaaaaaataaaaatggatgtttgtccattagatgtttatgagcaaattaggggagagaatacatttttgttagaatcagctgaaggagttccaaaggtggcaagatactcaatcttaggaaaagctgaaggaaaagtaatatttaaaaatggaaagctgaaagttgaaagctttacagaatttggagataaagctaaagatttagaagggaaatacgaatgtcccttagacgctttaagagaggttagaaatgaatatcttaaatacattgatatatctaacattgagccaataccaagatttaaggggggtttagttgggtatttaagctatgatattatcagatactggatagatttatcaaatatcaacccaaagccaataaatgatttaaaatttccagatgcagagttctttattgttaaggactttatttcatttgatttaaaagagaaagtaattaatttaatagcagaggatgatgaaggtattagagaacttgaaagaattataaaaaatgcaaaaattggaaataatgacaataaagaagaaaaaactacagaaaataaggacttaaaaataaaatctaacatgagcaaagaggaatttattgaggcggttaaaaaagctaaggaatacatttttgctggagatatcttccaagtggttttatcaagaaggatagagatagatttagataacttagaccacttgaaaatttacaaaaaagttagagagataaatccttccccatacatgtattacttagattttggagacagaaagattataggttcatcaccagagattttggtaaggacagattataaagataataaaaggctggttataacaagacctatagctggaacaattaggaggggtaagacagaagaagaagataaagagttagagaaaaagctgttaagtgatgagaaagagagggcagagcatgttatgcttgtagatttagcaaggaatgatattggaaaaatatcaaaatttggaactgttgaagttactgatttcatgattattgagaaatactcccatgttcagcatatagtaagtaatgttgttggggagttaaaagacaattatgattcattcttagctgtaaaagctaccttcccagcgggaactttaagtggagcaccaaaggtcagagcgatggagattattgaagagcttgaaaaaacttggagaggaccttatggtgggggagttggctatttcggatgggatgatttaatggatttggctataacaatcagaacctttgtaatctcgaaaaataagggatatattcaagttggtgctggaattgtagctgattcaatcccagaaaatgaatgggaagagacagagagaaagggaatggctaacgttaagacgattgagagtttattgaaatgataagtttagaaatggttttatagcaaaaaaattaaataatatgatttaaagatttggtgaaattatggcaattgcttatgctaagttgtatgaattaattcataaaaagattaaggatgaaagagaggcagatgagttatataatgctataatagagattattaaagaatccaaagttattgttaaaaatgagttaaaggatgagttgaaagatgaattagcgactaagaaagatattgatttagttagagaagaaatgaaggcaatggaagagagaatattaagatatgttgataacagattcaatcaacttttaattgttcagttgataatcttatttgctataatcataacgaatcctaacgcaatagaattaataaaactattatttggttttaaataaattaaaaaatccaataaggaggggataatcataattaaaaaactaattgaagcattaagacaggcacaggatgaagattttaaaatattaaaaattatagagctgtcaatgagacatcatgagtgggtgccgttagatgagattgttagaaaggcgaagatgccagaaaaggacgtgctttacagattaaagaggttgaacaaatttggatttgttgtgaggagcacttatggttatgctgtctcaatgggaggctatgatgcccttgcaataaatgcttttgttaaaaaaggtatcttaaaagccataggtaataagttgggagttggtaaggagggggatgtttatactgtcttgctgagtgatgggagagaggcggttttaaaatttcataaacatggaagaacttgctttacaagaggaaagaggtatagaggatatttggctgataaacatcatataagttggctctatgtttcaagattaacagctgagagagagtttgagattttaaatgagttatttccaatagttaaagtccctgaaccaatagaatggaatagacatgcaattattatgggtaaagttgttggagaagagttaaagagattagatttatcagaatttatgagtaaagaggagattaaagatttattctggaaaattattgaagaggttaaaaaggcttatgaaattggctatatacatggagatttgagtgaatttaatattttattagatgaaaatggggattttgttattattgactggcctcaggcagttcctaaataccatccagatgctgaattttacttaaagagggacatttggaacgtaataagatactttaaaaagtataagattgacaaagaggatgagaagattgatgttgataaaatctttgagtatataactaaataacggttttggtgaaatcatgagtatctataatgaattatataaattaatgcttgaataagttaaagataaagaaaaagctaaaaaatactccaaaataatagttgagttaatagaagaagggtcattggagattaaagatggaaagttagtaattaaagctgattagatgatatattttggtggaattatggctattgcctatgctaagttatatgaaattatagctaaatatattaaggatgaaaaaagagcggaagaactgtataatgcagttgtagaagttattaaagaagaaaaaattattgttaagcatgagttaaaagacgagctaaagaatgaactggctacaaaagaagatataatgcttgcagaagaacgaatattaaggtatgttgataatagattcaatcaattagacaaaaaaatgacagttggatttgtgattttgatactactctatatattaacaaatccaaacgctatagaactaataaaactactatttggagttaaataaatattaaataagtgaagttttatggcatttgatgaaatttgtgatgagattatattgaactatgaggatgccaaagattttgcttatatcttaaaattaacttatttgaatgaatttaagaaacttgaaaatttaaatttaaataaatttgggattattaagaaagatgatttgtcattttatggaaagaactacccattatttaaaagtttattatttttcaatgaaattcccgtatttaggggggagaaagagagtattttatttttaaagagtattgggctatctccaagaattacattgaattctttaacatataaagagaagataaaattaggcaatgaatttctaaaaagatgtataaactttgtccctaaagaatacataagttatattccccaattaatttttgggaaggaatattattttagaggagtttgtttaaaagagtatgtttctgctttaaatggactttataagattggtaagaaaaagaaagttaaaaaattaattattaacatggaattacctgatgagaaggatgttaaaaagtataagaagaaattggcaaagaaaataactctatttaataaaaaattagagaactatgagataaattactttaacttaaagtttaataacaaaaattttgaatgtcaatatatatacgttaaacaatcagtatgggataagattttaggtttgtttggggaggggattgaattaaaatattatccaacattggttaatatcgcttattcatctgaaaaagttgatttcttaaagccattttttatatttgttgataaaggagatatttctgtttatgcaaaagttcctaaacttatttatttaaaagatggattatctttaaattatttaaatctaagagggaagtatgtatatttcggtaattgggaaaaagataagttttgggaaattattgaaaggggagtattatgagaaaatatttgataatattggtgctcctcttatttttaagtagtagttttggttattattttgattatataaaagttagtgagagcaatcctattaaaacaataacatttaaaattaataaagctgaaaactattcctataaactcagttttgttcattatggcaatataaacaaaagtatgaaggtaaatatttatttaaatggaaatttagcatatacaattgatgattccaatgatgcctctcctgcatataagaaaaatgcctctatagatataacaaattatttaaaagatggagaaaatgttttaaaagttgaagggatgaatttaattggaaatgaaaattatcacccatattatgtcctaaaagatatttatataaatgagccggctaaaactccaatagattttaaattaatgatttatgctttgttgattatttgttttttgatttataagaagtgctaaaaattaagaaaatttaaaataatgttaaagaaaaagttgatgcatgaaatattgtgaattttataaagttatgaaaaataacataaggatacataacctacaaaccttaagggttgtattatgagaaaaataaaattaattatctttccaggatattatattccacatattggtggattagaaactcatgtagatgaatttactaaacatctttcagaagatgaaaattacgatatttatatatttgcaccaaacattccaaagtataaggaatttgaaataagacataacaatgtcaaagtttatagatatccagcatttgaaattattccaaattatccagttccaaatattttcaatataaaattttggagaatgttttttaatttatataaaattgattttgatattgtaatgacaaggacaaggtttttttcaaatactttattaggatttattttcgcaaaattgagatttaaaaagaagaagttaattcatgtcgagcatggtagtgcatttgttaagttggagagtgaatttaaaaataagttatcttatttctatgataaaaccattggaaaattaatatttaaaaaggcagattatgttgtagcaatatctaaggcagttaaaaacttcatattagagaattttgttaatgacaaagatattccaataatctataggggtttagaaattgaaaaaattgagagtattggagaagataaaaaaatcaaggaaaaatttaaaaataaaataaaactatgttttgttgggaggttatataagtggaaaggggttgaaaatattataaaagcttatgttgatttgccaaaagatttaaaagaaaaaataattttaattgttgttggatatggagaggatttagagaggttaaaaaaattggctggtaattatttaaataatggcatttatttcactggaaaagttgattttgagaaagcaattgcaattgtgaaggcatctgatatttatattcactcttcatacaaaggagggggcttatcaagctctttactgcaagcgatgtgttgcggcaaagcgatagttgcaagtccctatgagggggctgacgaagtagttatagatggatataatggcattttattgaaagacaattctccagaagagattaaaagaggaattattaaattaatagaaaacaacaatttaaggaaaatttatggtgaaaatgcaaaaaattttataaaagagaattttaactggaagaagtcagttaaggaatataaaaagatttttgagagattagttaattaggtggtattagttgagttataaagaaaaggcagttaaaggcgtaagttggcatcttctttcatatttcttagctgctccaatagcatatttagttagagttttatatgcaaatgaaattcctaagttagatgttggactattttatgctgttttagatttttttagtatgttagtagtttttagggcttttggtttagatcaggcacttataaggtatattccaaaatatttagcagagaatagattagatatgttgaaatcatcaatcgtttttgtaggaattttgcaaacaattttagcatttattgttgcatttttagtagttatctttgcaccatatattgcagagttttatattaacaatcaagggcaatttaccggaagattggatttagttattaatattttaatcattatggcaatgggatattattttttagatagtatcgtagcgtttttttcaaatatattaacaggctttcaacttcagaattatgcaagttcaacaagagtcgttagaatattaagcgtttttatcttttcattaatttttatttatctttttaatgttcataacgcttatgttccctccgtatcttaccttttgatggctgttgttatgattattatttatggatatattgtagttaaaaaaatatttccaaagtttgctaaagaaaaagttatattttcaaggaaattaattaggaatttgttttcttatgggatgtatgtgatgataggttatgcgggaagtttgatattgggatacttagatgggatttgtttaacctattttactggcttaaatgcagttgccgattatagaaatgttgctatgccaactgttaatattctaagttattttgccttttctgttggagcagttctcttccctatgagttctgagttatgggaaaagggttataaaaaggcattaagttatggtgttgagaaagtttttttgtattctctgattattgtaaccccattggctatcttgatggcatattttccaactgttatcatcaatattttatttaatcccaagtatttatccgcagcccctgctatacagattttaagttttggggcaatgtttttaacatttaattccatagggttcaatattttaaatggcattggaagaccaaacatatcaacaaaaattttgtatattggagcaagttttaacttaatatttaatattttgttaattcctaagtttgggattatcggggcagccataactactgtatttggatactttataatgtggattttccaaatatggtttttaaataaacttttagaacaccaatttctaaataaaaaatggattttagttattttagtaggaatttttagcttaattccagttatgttcattaaggatttgattgataatgttatattacagctatttgtttgtggagttgtttattttggaatatatatattaggaatttttgggcttaagataataaatatatatgaggttaaggatattatctccaagattataaaaaggtgagtaaatgataagagaaagttttttgccaccatttaggccatgtattggtgaagaagagataaatgaagttatagatacattaaagtcagattggataactatgggtccaaaaacattaaaatttgaagaattgtttagaaattatattggaagtaaatttgcaatatccttaaattcatgcacagccgggttacatctgtcattggttgcattaaatataaaggataaagatgaagtcataactacaccatatacctttgcagcaactgggaacgttatagttcatcaaagggcaaagcccgtatttgttgatattgataaagaaacctataatattaacgttgaggagatagaaaatgccataactgagagaacaaaggcaataattcctgtccattatgcaggacatccatgtgaaatggatgaaatattaaaaatagcaagagactatgatttatatgtaattgaagatgctgcacatgcattgggggcagagtataaaggaaaaaaaataggtactattggagatacaacatcattcagcttttatgcaacaaaaaatataaccactggggaggggggaatggttactactgacaatgaagagattgcagaaaaaataaaaatactgcgactacatgggataagtagagacgcttggaaaagatactcatccgagggctcatggtactatgagattatcgagtgtggttataaatataacatgaccgacattcaagcatcaatcggaatacatcaactaaaaaaagcagagataatgagaaaaagaagagaagaaatcgctaaaatttataatgaagagtttgaaaatcttgaggggttaataactccaaccataaaaaaacatgttaaacatgcatggcacttatatccgttgttaataaatatcgatagattgaagataaacagaaccaaatttattgaagagttaaaaaaacagaatattggaacaagtgttcattttatcccattacacttgcatccattttataggaaaacttttggatataaaaaaggtgattttccaaatgcagagtgggtttatgagagagagatttccttgccaatatatccaaaaatgactgatgatgatgtaattgatgtagttaatgcggttaaaaaaattgtttctgagaacagatgaggatgatattatggaaaagataaaaattggagatagatatgttggtaaaggtgagccaacatttattattgcagaggggggattaaatcacaatggggatatcgatataggtaaagagttagtaaaagaggcaaaaaaatgcggtgctgatgcaataaaattccaatcctaccatactgaggatttcataagcaaaaaatcagaatattatgaactatttaaaagtttagaactgtcagaggaggaattctatgaactaaaagaatatgcagaaaaaattggaattatgtttatctcaacaccattagatttaaaatatgttgatatattaaataaaatgaatgtgcctgcatttaaaattgcctctggtgatttaaccttttatcccttattagaaaaagtggcaaaaacaggcaagccggtgattttatctacaggaatgtctgatattggggaaatttgggaagcagttaaagttttagaaaataatggatgcagggatattattttattgcattgtatttcatcttacccaaccccttatgaagatgtcaatttaaacgctattaaaaccttgaaaagtatattcaatatccctgtgggatattctgaccatacattgggaatactcgccccagtagtttctgttgccttaggagcggatgttattgagaagcactttaccttagataaaaatatggaaggtcctgatcatgctttgtcagcagacccagaagaatttaaggaaatggttaataacataagattagttgaaaaaatgcttggaagtggggaaaagataccaatgccttctgaaagagacgttattgttgaagcaagaagaagtattgtagcaaaaagaaatattaaaaaaggagaatacttaagtgttgataatatttcatttaaaagaccggggagaggtattgaaacaaagtatttgagcataatattaaacagaaaaatcaaaaacgataaagaagaggatgatataatatactgggatgatttattaggggattgagcatgattaaattgttaaaaaacactttaaaagatccaaaaaaaattatgagggctttggaatttgccccttcttttgtttttgggaagatatatttgtctatttttggtataaatcctttgaaggttcataattttggaaaaatccatattagaaaatatgacagctctactataataatcaaaagtgggattcttttaagggatgtagaaatagcagcaagaggcaatggaaaaatcattattggagagaactttcactgtgaaccgtatgttagattaaacgtttttgaagaggggattttagagattggagataattgtggaattggttcattttcaataataaatgctactaaaaaaataacaattggtagtaatgttttaatttcaagtcatgttcatattattgatggagaccatggatttaaaaaaggagaattaataaggaatcagaaaatggtctcagagcctattgaaattggagatgatgtttggattggaacaggagttaaaatattaaaaggggttaaaattggggaaggggctgttattggagctggaagtgttgttacaagagatattcccccatattcagtagctgttggagttcctgcaagagttataaagaagagggaataacatgaaaataataggtataatccaagcaagaacaggttcaaaacgattaaaaaataaggtattattgaaacttggcgatagatgtattttagagattctcttagaaagattaaaaaaatctaaaaaattagatgatattattgtcgcaacaacaattaaaaaagaagataatgcaattgtagagctttgtaatagtttaggagtcaatgtttttagaggttctgaaaaggatgtgttggataggttttataatgcatctaagttttatagtggggatgttatcgttaggataactggggataatccactaacatctattgaattaatcgataaacaagtcgaatatttattaaaaaataattttgattatgtatcaacaaaaaatattattttgggtttaagtagtgaggtttttacctttgatgcattagagaaagcatggaaaaatgcaaaagagaaatatcaaagagaacatgtaactccttatatttatgaaaatccaaatttatttaaggttttttatttagaacctccagaatatctcaaaagagagggtattagattaacaattgatactataaaggactttaaactttatttagaattacaaaaacattttgatttgattaatgtagatattagacaaattatagattttttagataaaaaccctcaaataaaaaatataaattcaaatgtaagacaaaaatcatatagagaggtggaggaatgaagattgctatcattactgatggcagtgttgagatggggatggggcatgtttataggacattatcattagcaaatgaactaagaaagtttaatgttaatgaaattatattctttacgaaaagtgatgaggatgtgattaaaaaaatagaagaaaatggctttaaagttataaaatgtagcgataataatgatatcttaaaaaacattaaaaatataaagccagatgttgttattattgatgatttaggtattgaagaggatttcgcaaagaatataagagaattatgcaaaaaattgatattttttgataatccaaatccttcatcaaataaatatgctgatattgtggttaatgcaatagttggaagtgaattaaaaaacagaaaatattttgatgaagaaaataaaactttatatttttatggaccgaagtatttgattttaagaaatgagttttataaggttaaaaaagaaatgttgagtagaagtaaaaataaagagacaaaaaacatattaatagcttttggtggaagtgatccatcaaatttaacctgtaaggtattagaagagcttctgtctaaagatagagattttaatattaacgttgttcttggacctaagttccaatatgaagacgaattgaataatttattaaaaaggtatagtaaatcagataaaataaaaatctacaaaaatatagataatatggctgaacttatgaaagataatgatttaattataacatcaccaggaatgacgatgtttgaagcactattcttagggattccagtggtcgttttatatcaaaatgaattacaaagagaatgttatgatgattatttaaagaaaatatctaaaactcatttgaatcctttaaaagaaggatattttatagatgcagagcatactgatttacatataggaaaagggaaatttgagattattgaagctataactaatatatataattgtaaaaaaattggtgaagattccaaaattataattagacaaattaccgataatgatctcgaacttttaatggcatggagatctaatccattaatatataaatttttttatattcaaaaagaacccctaaagtgggaagaacactattcttggtggatgtctcgtgagaatagggtagattggataatactacttagagaaaataatacaattagaaaagtaggtagtgtaaatgtttcacaattgaatactgataatccagaaattggaatactcattggggagttctttttatggggtaaacatattggaagacattcagtttcactcgtgcttaagtggttgaaaaatataggatataaaaaagcacatgcgagaatattagaaaacaacattcgatccattaaactttttgaatcattaggattcaaaaaaactaaaaaaggtagagaaaacgaatggatatacgaagtgaatttataataaggtgaaaaaatgtttcaagatatatcaaatttttataaagataaaactattctcgttacaggaggaactggctcaataggtaaagaaatagtaaaaacattattaaaatttaatccaaaaacaattagagtattagatataaatgaaactgcattgtttgaattagaacatgagctaaattcagagaaaattagatgttttattggggatgttagggataaggataggttaaaaagagctattgaggaggtagatgttgtattccatgcagctgcattaaagcacgttcccctctgcgaatacaacccatttgaagctgtaaaaactaacgttattggaactcaaaatttgattgaagtagcaatggatgaagaagttgaaaaatttataacaataagcacagacaaggcagtaaatccagtaaatgttatgggcgctaccaaattattggctgaaagattaacaatttcagcaaatttatataaaggaaagagaaaaacggctttttctgttgttagatttggaaatgttctaaattcaagaggttccatactgccattactaaaagaacaaataaaaaaaggagggcctgtaactttaacccatccagatatgacaagatttataatgtctattaatgaagctgttaaattagttttaaaagcttgttatttggctaaaggtggggaaatattcattttaaaaatgccttctgttagaattaaagatttaattgaggttgttattgaggaactcgctccaaaatatggatataaaccagaagatattgaaattaaaattattggaaagaggcctggtgaaaaactatatgaagagttaattatcgaagaagaaatttataacttagaagagttagaagatatgtttgttgtttatccttatggagtagatggaaataaaaataataagataatttataattcgaaggatgccaaatttttaaataaagagaaaattaaaaaaatattaaaagaaattagttatttataattgtttatttaaaatttcaaaaaatatttcctttaaattttttctaaaatattttttaaattctttatcatccatcataaatgtttcttttgcattggattctaagaagaaacttttacttccagcatttaaaagttcataaatcattgttgaactcatccctattgtatattctggaacaaaattaagtccatttattatttttatttcttttatgttttttaatttttctaactctctaattgagaaatcattcaaatactctccaggatgaggtttaaagtagaaagaataaccatgttcgattaaagtatttattaattttttatctctaaaagtattaaatatctcttcataaaattcaggataaccttgagatacaaataatatcgttttttcttttttaggatattttttccaatataagaatcttgggtctggaaagacaataactttatctttcggaaagttatatttatcaattaagagtttttttatattttcgttccaaactaatttacaatctggaatacaactatatttttccgatattggaagatggatatagttattgttaattacctcatgactaaaggcgatagtttttatattttttctccacaacctataaatattgcacagataaaacatgaagtttctttcagagtccccaacaatacatttaatattggtttttgagatataatcctttatagataaatagaaccataaaacaaaaggtaatttatgttttaagaatatattaaacattgtatgaataaacttttcatgttcatcattgtagttagttaaatttacttttttaaaaattttagaagagtttagcaatatatcaaaacccaactttaaatttaaaatatcttcaataaataggtaatcttgtctctttttatagtaatctttaatatattttggcaaattgataaaattatacttagtaaataaaattgagtaattcttatctgttaaattaatatcaaaattttttaatagttttttaaactcttcattcttaaataaatgattaccaaaaaatctattatttccataatatctgtcgtaatctgttataaataatatatcaaacctgtaattgttatttttgttcattattatttttctaactaaaaaatatagcataattaaattaccttgaaaattttccataatataatccactattctatttttattttttgattttatattattggtaaatttttttaaatattttccaaaataatcaatatttacatatttctgatttaaaataaatgttatatctttttctgattttaatatatcatcaactctttctttaaaattataccagatatagaatggcatttgatttgtgtgatataggttatcccaattaattaaaaaatataagaaagtgttatatactaaatgctcaaactcatcctttttaataaatttgttatttttgtatgagttagatactaactcctttataaaatcaagataacactctaatttttttaatggtggatatgtgttataaaataattttatttctttttcgttaattctaatgaaattaaagttatatatttctacaatcatattgttccctcaattaatagtttccattctttaattatcttttcaatgtcaaaatccttagctctttctaacccattagaatatctctttctcaaatcttcatcttcaatcatcttaatcattaaatcagctaacattttctcttcttcgattaaaggtttttcatttaaatcttgccatataaactctcttgaaaatggtttagttaatatcccatactttccataataaggataatcgattttatcacttatatttaactctgggcataagatttcccttggaccagttttacaatcagttgatattacagggaggtttaacgataacgcctctataacagtgtttggtaatccctcccacaaagatgagaaaacaaaacaattcgaatgctttaaaaatttgaatggattcttctgcatgcctaaaagataaacattattttgtaagtttaatttatttattaattcttgaagtttattttttaactccccatctccaagaattattagtttagcgtttgggtatttttcagtaacccttttaaaacttctgattaaaaaccactgtcctttttgttcggttaatcttccaatatttataaatacaaaagaatctttaaagatatttcgatattgtttttccaatggttcgttagatagttgttgaagtttatcaatttcataaacattcggaacaattttagttttattttttaatgatttaaaatgagattctattattttcttattttcctgtgtttgaacaattataatatctgcatatttataaaaatatttatatgccagtataataattttagaataaagaccttctttatatgattctattgggttgttcctaacccataaaataaatttagtattgttggatattttaaaaattttatttaataatattactggaattattgaaacatttgcatcatcatgatgggttataactaaatctggcttgaattctctaataatttttagtatcttataagttctttttaaaattttaaacggccaaagtagaggatttttagatttttcgttaaatagtattatcttttctttgtcaatttcgccctttaaccatggctcataaaatgaaatatattttgattcataaagtttgtcaaacatttttaacactgaccagaaatcccaaacagtccccattacagttaattgtttctttttgttggacattctaatccctcaacttttatatttttctctttactaaataaccttcaataaacattgcgtcaatattacaatcaatgaaatcagttattgcatcctcaggagttctaacaattgttcttccatgcaaattaaaagatgtgtttataacaattccataaccagtaatctccttgaatttttttagtaatctatagtaatttgggttatctttttcttcaacgaattgtggtctcgctgttccgtctatatgcattgcagaaggtaacttatcccaaaattcttttttcattctgaacgctattgccatatgtttatgtttataagacttttcaaataatctttctctttcttcttctaaaacagaaggacaaaatggttgaaaccatggtctccttttaacagtagaatttattttatctcttgtcttaggatctcttggatctgctaatatacttctatttcctaatgcccttggtccaaactccatttttccttgataaacagctattatattaccttttgcaatcatctcagcagcaatttcaggccatttttcacctatatattcgtaagttattttatctttccatttatctttttttaactctttttctacgtcttctcttgagtaattaggtccccaataaggcatttctaaatcttttaaccatgagatatcttcacctaattctacagcctttaatatcgcagcccccgctgctactccatcatcacccattgctggaaatatatagagttcttcaaatggagttctttcaaaaatattcaaattcataataacatttgctaccacaccacctgccattgcaagtctctgtattttaaatttttcatagacaatatttaagtattcaacaacagtatcttctagccatctttgaatggttgctgcaaaattttcatcacctattttttctttccatttttgtaagtattgtttattatgtaattttttaagtatgtttatatcgtgttcccatctaagtttttctttatttattttgtatcctttttttaataaattatataattccccattaggctttccataagcagctagtgcttctgtttttccttcatcagaatttggtgtaaaacctaaaatttcagtgaatagagaatatatatgcccaattgaagctcctttaaatataccttccacatcatcataacaaataatatcaaaactagaataggatactaatctataatcatattctttaaataaccataaactatgatatttccagtcccctattccatcaagagtaaaaaccaaggtctcttttggaaagaatggactaaaatagtatgctgaagctgcatgacataaatgatgctcatacaacgaaacatcttttctaaaaatttttttcaattctctttttatagctaagtttcctaatttattatatatgttattaaatcttttaaataacaacttccttaatccataaacagccagtatctcccaaataaatggtctatatatgttgtttaaaacaaacttagttttattttgtgataactcttttttgtatttagcatattctttaatatatttgggcttatatgttctctttatatagtcatctatatgtttgaataatataaaatctaaattagtttgttcaaagggatatgccacataatctatattttttaattttgggtattcatttagtattggaattactgtcccaccatcatgctttattctcgtaactctttcagttaagattccaaaaatctccttattctttgtatcaatataaaaaacaccactatcatgtaaaaaatattttactcctaagattttaaccataattccacctttaatgtcctttcgtactaatttcagtctttttatcttttatatcgattaaaatctttaaaataaatgttggcgttaatacgataaataaatatactaccaaactataaaaaaatactttccaaaaataaacattgttgcagaaatgttttttatttttccaatgtgtttttaaggtatagtaagaatataatttttgttttttgattctgcttaaataattgtctctatttggaattctatattttaataaaaattcctcaattatgtcaaatttgtaatcattggctatacatctaatccaaaaatcgtagtcttgagacctaattaatttctcatcgtattttaatttctttaagattttactctttaccatcatagatggatgaacagttaaatgttctttgaaaaaatattttttaatttctttaaatttatatttttctggcttaaactcttttaaaatatttccattttcatcaataaaataaacccagctaaacaataaatcaatgtctctattattttccatatatttaaattgtttttctaatcttttaggtaatgcaatatcatcagcgtctaatatggcaatatacttcccccttgctataktaacagctttatttctactggctcctctacctaaatttctttcattttttataaaaataattcttttatctttctgttgatattctttaataatttcctctgcttttttattatttggattatctaarrcgattataaaktcaaaatctttaratgtttgatttraaattgactcaatagattcctttaaatatttttctggttcgttgtatgttgccattacaactgaaactaatggcttatccatctctcccaccatttaataaacaaaaacaaccttatcaaataattcctatacaaactttgttctttatttttaaaaactttctctttaaagaattcatataactcataatcaacctcttttaatatttcaactttttcaaaaatctcatttaaatatttttcttttaaaatccaatctgctaatggtggagtaaagccttgctttcccctattaactatctcttcaggtaaaatatctttaataatctccctcatcaacttcttggttttgaacaaatctaccttccattcagttggaattttttggctaaattctgcaaacctataatctaaaaatggacttctaacttccaaagcgttagcatagatgccctatcaaccttaactaagaaattatcacacaaagtattaaacaataaatcaaaaatccttagggcttcccccaacttattatctcctttattcaaacaatatcttaatttttcaatagtccattttttataaatttctggtcttatcgcatcttcttttattgattcagcatagaattcctctggatttattaaggataacctaaacgcctcctttaataaatacaaattagcaattccatttaaatctttcttaacaggtaatttagaaccaacaactctcaaaaatttaggtaattttctaatgaaatccattctatatccgtttaaatgagtcatataacctccaaaaacctcatccccgccatctccactcaaaacaacagtaacaaatttccttgccatttcagagaccttataagtagggaatccactataatctccaaacggttcatcgtaaatccagctgtatttatcaatcaattcctcaaaatctctctccttaaagtagtaatgatgatgctgagttttaaagtaatcaacaactatcttaatataaggagtttcatcatactttccttcaaaacctatagaaaaaggtatgcaatttacttaaatctgtaaattccctcataactccaacaactgtagagctatctaaaccaccactcaaaaacgctccaactggcacatcactcctcattcttatcttaacagcatcatataatagctttttaccttcttcaatcaatttctttttatcataaataggtttgtaatctggcaactcccagtaataatattttctaatctctcttttatccaaatcaaagattaaattctgtcttgcctctaatttaaaagtgtttttataaatagagtagggagatgggataaatcccaaggcaaagtataactcaactgcatctttgttaatattttcttttttatttatctctttaactgctaaaattcccttcaattcagaagaaaagataaattcatttccatcccaataataataaaatggcttaactcctaatctatcccttgaacaaaagattaagcccttctttttatcaaaaatacaaaatgcccacataccattaaactctttaacacaatcaaaacccaacttattataaagctttaaaataacctctgtatctgtccctgtttctgtctctaagttaaatttttcttttaactccaaataattataaatctctccattataaacaatgattatatccgccctatccaactcatcatctctataaatgattttatcctcatcaacattataccccatcggttgatgtcccttttcacttaaatctaaaattgctaatctaacatgtcccaaaccaatagaataatttttaaaattataaataaagattccttcatcatcaggacctctatgtttaattgctttattcatcttattaatttcttcttttataacttctttaccaaatctaataatcccatttatcccacacatcattccaccaaaaaaattataatcttaaaagccaatctttattttccaaaaaccagttacaaaatctctttaaaccctcctcaatagtaacttttggtttataccccaacagcttttcgctcttactcaaatcagcataggttcttaaaacatctccatcctgcattggcaaaaatttcttttttgcttttttgttgagatatttttcaattaactcaataaaatacatcaacttaactggtttagaattacccaaattaaaaatctcataatcaaagtcctttttaatagctctcaatattccatccacaacatcagaaatataagtaaagtccctctccatatttccatagttatagacctcaatctccttacccaataaaatgttttttgcaaacttgaagtaagccatatctggtcttccatactctccataaacagtaaaaaaccttaaaccaatcattttaataccatatagatgatgatatacatgagccattaactcattacttctctttgttgaggcatatagagagattggtttatccactctatcatcttcactaaaaggaatcttcctattccctccatagacagaagaagaggaagcataaacaaccttctcaatatcaaatcttcttgcaaattcgaagatgtttaatgttcccatttcattggattttatataagcccatgggttttgtagagaatatctaactcctgcctgtgctcctaaatgcacaatcaaatcaatctctttatcttttaaattttcaactaaatcatcccaatctgaaaaatccaattttataaacgtataattttcataattttttaaaatttcattccttttttcttttaaaactgggttatagtagttatttaaattatctattccaataacctttagatcttcatagttatccattaaatatttacttagatggaaaccaataaaaccggcacttccagtaactaagatatttttatatttcatcttcccactccataatatttaaatcccaactttttaatcttttcaacatctaaaatatttcttccatcgaatactactttttctttaactaaatttccaatcttttcccagtcttccttattaaaatcatactcaacagttattattattccatcgacatttttaactgtctcatataaatcatccaatacatacaagttatagccataaaatccttttgatttatctaacttatacatgttgatggtgttttctcgtgccttttcaacataatcaaagcccttaacaatagccccactctctaaaagcatatcaatcaattttattgccctactctctcttaaatcatcagtatttggtttaaatgctaaacccaagacagcaaaggtttttccatttaaatttccataataattcttaatcttttcaaagaaccattttatttgctcttcattgacgatgtcggtagcttttattaatattggttctatgttgttattttcaaattgttttatcaatgctttgacatcttttgggaagcaattatggattaatattccataagatgttatgagcagggagttttctgtttctacgctatatacataaccgctataatgctcttttataatttctttaacctccaatatagcaaagttatctgatttcttataacctaacggttctatgtttcttttatagctctctgcaatatctttgtagttttcccattttttaccaaataactctccgattttcttaacttgttctaatccattgattcttataatataagccatagttgttgatttgttgttgtagcattttttcacggatgccacaatacccaacaattgcagtaatatcaacaaggaatgagccatttttttactgacagttgcaaattcaatatttagatttttgttgttatttaaccttacaattccgccatctcctctaaaaagaccttttaagaactcccattttatttcctcttttgcattgaacatctgtggaggaatatttttattataacagttaattccacagtttaagatattttcaaatacataagccaatatttttgatgagatgaggattgaatgagaaccgtcttttattttttctatgtattttatacctaatttgtttaatatgtttttaacatcgtttatgtattcctcttcatgaataccaaaacatagtccaattctcttccttacaacaccatttcttccatagtcttttgatatccagccttctgatagataatagccaattaaccttgcaaaatccttatctatctttattttatatgggattgttgttgatttgctttttgcagtaaataatctattttttgaaccatatttatccaaaatttcttttattggtagtatatccttagctcttattgttccatttctcttaacatcgtgaggatatttgtttgataagtatggttttataatgttaaattcattggttgccaagtccttattgtgtatccaaactttttcaataaggtctgtcttactgagttcttctaaaatgtctatttctatctccctttcttctccaaagtttccataaggtaaaattaccttatccccctctttaacatcagatgtcaatttaatttttaattctccatcttctaaaatcacaactgggtggtcttttgttatctttatttctctacctaaattaaacctcaaagtaattaaatcatcgttgtagtatctttttgatgctaattttaacttttttaaagataatttttctccatcaaaggatagaatctttacattatctttatcttctaattcaaataattctttgaatgttatgcattctaaacctctacctctatctataaataaaacttcatctgggtggaaacagctcccaccataaccaatcccagcatttaaaaacttattcccaattcttggatctaaacccatagcatagcttattgtttttatatcagctttaactttatccgataattttgccaactcatttataaaagatatctttgttgctaagaaagcgttagaggcatattttattaactctgcagtctcccagtttgttattacaaatggaatattcttatctttaaagtatttataaacttcttccataatttctatcggttttttattgttaaggttttcaaaccctaaaattaccctctctggattgaaaaaatcatagacagcaatcccctccctcaaaaactccggatttgaaacaacatccacattataatcctttaaaagctctttaaccctcctatttgttcccactggaacagtagattttataacaataaccttataatcctccttatctattgtctcttttatcttctcaactgcagaaaatagaaatctcaaatcagcatttccgtctttatcttgaggagtcccaacacataaaaagataacatctgaatcctttattggtttataagaagtagtgaatgttagattcttatttacatgtttttttaataacccttccaaaccttcttcatataatgggcattcgcctctgtttaacgctttaactttcgattcatcgatatcaataccaacaacatcaaaaccaaactcagccaaaccaactgcctgtattaagccaacataaccagtcccaataactgaaatgttcatttaaatcccctgagtttatttattaataattgtataatattattatatttctcttacatcgataaccctcagacataaaattacagctaaataaactccaaaataaactactcctccaacaattaattgtaaatatagcattacttataattttcgttatcaataccagaggctgttaagttaacgacttcacccaattgtagaacattatggagctttttactcaactaacaaccgtatcgaatttactattacttggaaatctatttaaaacctctttaatcttgtgataataaattctaatcgattcgtgacttatatcttcgaattgggagggggataaacccactttcctcaatgataatccgaggtagtataaaagccctgctaagattttaacctctatcgattcctattccttttaaaaagcttcctctctacgattttctcctttataacttctatcatgagcctcatagtttattattttttatcaatattttgataaaaacttaacttgacagtctcctctgaaatctacaaaaactttaaatactaagcaaaattataaaatagatataaggaatataattaaaaataaggtgggggagagtcatgataccattagttccaacatcaaagacagaaatagacaagttagagcatgttttaattttgggaacattgttcagacctgaaatcttggagttaataaaagaccctatagagaaagttacttgggttgattccttagctattgccgcaggagctttagcaagagagaaagctggatatacaataagagaaatcgcagatgagttaggaagaactgaacaaaccattagaaagcatttaaaaggagaaacaaaggcaggaaagcttgttagggaaacctatgagatgatgaagagaggggaattaaatattgaagaagtagaaaaattcttagaagctgttgtcagaaaagaagaattagagaagataactgacattaagaagttagaagaagaaattgaaaaacttaagaaagagaatgaagaattggccgcaaaattagaaaaggttaaggagaagttgaaagaagttttaagtgaattagagaaataattaaattttgattctattttatttttgcttttttattatttttatcaatttttaggtgatttttatgagaaaagtcgttgctgaggtttctataattcctttaggaaaaggagcaagtgtttcaaagtatgttaaaaaagcaattgaagtttttaaaaagtatgatttaaaggttgagacaaacgctatgggaactgtattagaaggagatttagatgaaattttaaaagcttttaaagaagcacattcaacagttttaaatgacgttgatagagttgtaagcagtttaaaaattgatgaaaggaaagataaagaaaacacaattgaaaggaagttaaaagcaattggagagctgtaattggtgtttgtatgattcttggaatttgtgatgggcataatgcaagctcttctttgataaaaagagatgaaatcctatttgcaatgagtgaggagagatttacaagaaagaaaaatcagagaggattcccagaaaaatcagtagattatattttaaacaaagttaaacctgatgaaattaattatgtttctgttggtggagtttttagaagaggagagagaataaaaaaattaaaagaatttcaaaacagaataaataaaaaatttctctatttttatcatcacatatcccattcatatttatttaaactctcagattttaaagaagctttagtaatttcaatagatggaggaggagatggtttatcttttttggcatccatagcaaataaaaataacttggaaattatagcccaaagtgatttaatcgactctgttggagatttttatgcctcaataactgagcttttaggttttaagcctatggaagatgaaggaaaagttatgtctctatcttcttacgaaggagaagatgatataaatttaacaactattgactatataaaagaattaaaatcatttaaaaattatttaggagttattggctatgaagctaccaaagcattgaaaaaacttatagttagcgataaaagccaattatcttttgaggataaggttagaatatcaaaatttgctcaaagaactttagaaaatattgttttaaaggcaattgatgatttatctaatgaatataacatagataacattgtgtttgttggtggagtggctcaaaacgttaagttgaattcaaaaattgctgaaaaatataatctattcgttccaccttttatgggagatgaaggactttgcttaggagcaagcttagccgataaaagaatagatagaataaatataaacaatacatactttggatatgaaattgaaaatgaaagagctgaaaaaattttagaggaattaaaaaataaactcaatgattataagatagagtttgttgaagagagagacattccagaggtcattggaaatttaatcttagataataaggttgtttgcctatcaagagggaaaatggagtttggtccaagagctttgggaaataggagcgttatagctttaccaacaaaagaaaataaagaaaagattaataaaaagttaaaaagaagttggtttatgccttttgctccaacaatactgtatgattttatagatgattatttaataaatccaagatactccccatttatgactcagatatttaaggttaaggagaataagataaaagaaattgagggggttatacacgtagataaaactacaagacctcaaacattaaaaaaagattcaaataaaacattctacggaataataagatatatttatgactctataggtattccagtagttttaaacacatcctttaatttacatggagagccgatagtttgcaatgagaaagatgcaataaatagctttttaaaggcagattttgatgctttgttgttagggaattatttaatttctaaagttaaataatcaaagtatttctctgtccaatctacaactccttttctctcttttttatgttttattgcttcaataatctcatcaactatattttcaacatctctatttgttgtatctatctcataaaccttgcctttactctcacataagcacacatctaaaatttctgcctgaatattttccaaaaccttttttggcttatagccccttttttctaacctttctttgataatttctggattgcatctaagaactataatatagtcgggattcaaaagatgagatacatgaccatctaatataatagttttttctttttcctcaatctcatcaataaatttttccaatttctcaaaatcaataacataagagtccatatcttcatctttttcagtatatagcttatatttcttaacagcctcagttatatcaataacttttattcctaatctgtctctcaaaacttttgaaattgttgttttcccaactcctggagttccagttattgctattctcatttaaccaccaaaaaattaacaagataaaaatgaactaaaataattaattattatatattaattagttttacacattttcagcatcgtccgtaatatttgaaacatatttatccaatatcacgtcatctctataagctaacaacacattctcagcaacaaaccctaatttaaaatttaaaatactcatataatccctaaattcattaagctcttttaaaatagattcaaaaggtacttcctcaaaatttacaattacaacgtcatattctgggattttatcttttatattttcaaagtctaaaggatgtttaatcctaacaacatacaattttggaagaatcttttctactctaacaacctcttccacttcttttacttcttccttttccttatgttctaaccctaaaacttctgattcagtttctgattcttcctctaatatataagctggtttttcttctccaataactatatactcttcatcagggacttcaataggttttggtaagtctttatttcctctaatcttctttataattttttttatgaccataattccatccctcttctaaatcttaaaatgttattttaatgttttattatataagtttaacttttataaggatgagattgtcaagttaagtttttatcaaaatattgataaaaaataataaactatgaggctcatgatagaagttataaaggagaaaatcgtagagaggaagctttttaaaaggaataggaatcgatagaggttaaaatcttagcagggcttttatactacctcggattatcattgaggaaagtgggtttatccccctcccaattcgaagatataagtcacgaatcgattagaatttattatcacaagattaaagaggttttaaatagatttccaagtaatagtaaattcgatacggttgttagttgagtaaaaagctccataatgttctacaattgggtgaagtcgttaacttaacagtcccagaattttccatataaaattatttaaattagatttctgcaagaaaaaatgtttgattgcataatgacactcaaagaatgccatagtgtctttcaaaaataacctttcaaaaaataaaatttatttaagcttagaatttgaataaaaactaaagttttggtaaggttgaaaaaattaactcagattagaaaattatatgtgtaaaaatttccaaaaaactatcaattcttcagtctccgagtgatttaacattaagagataacttattatcaacaaaatagattaattatttatgagaaatgtcccccctatatcctaccctctctcatccttggctctgccacgtcgagagcgtgggccgtagggggtaaaatagattttcttgaatcttaaaaataaaataaggatataatagtcagagagtttattctaatttaagtccttttctctctctaatttgcttaattaattgctcttgcatgtctcttggaactttttcataaccagcaaactcaatactccagagacatctaccctgagttgctcctctaatagccccagcgaatccaaacatctctgcaactggacacttagctttaatgatagccatatctccctcttgctccatatctaagatttgtcctcttctgttgctgatttccctcatcgctgcccccatgaagtcctgtggggtgtttatataaacaaactgcattggctctaataatactggatttgcctgcatcattgcatctctaataccaaatcttgctgctggaatcatttgtgctggtcctctgtggattgcatcttcgtgtaatactgcatccattaacttaactttaactccttgacacttctctgctgctaatggaccgtttctcatagcttctttgaacccttggataatcaattctttaacttcatctaaatggacaatacctcttgtcatgttaatgagaacgtttccttcatagatacacattactctcttagcttcttctggatccattcctgccttaattaactcctgaacaatcttatcatctaattttctctttgtatcaacgtctgggattcttccttctttgtatgcttgtaatacactctcctctaatggttcaactacaaagtagagcttgttgtgtttgtttggagatttactctcaactactggtgattgccctgttactgtctctctatagacaacaattggttgccctacttcaactggaattccagcatctctctcaatctttaattttgttataatctcaatgtgcaactctcccataccgcttaataagtgctctcctgtttcttcgttaatctcaactttaacggttgggtcttctcttgcaacttgtcttaaaacttcaattaattttggtaaatcttttgtgttctttgcttcaatagcgactgtaataactggctcactgatgtgagttattgcctcaaatggctcaattattttgtctggggaacagattgtttctcctgctgatgcctccttcaaaccaactaatgcacagatgtttcctgctgaaatgctatctactggaattctctcaggccccatgaagacagatacttgctgaatctttgccttttgctggttatttaccatataaacttcgtctccttgcttaattctaccactgaataatctacaaactgaaacagctcctgcgtgtttatctacaataatctttgtaataactcctgctaatggtccgttagggtcacagttgagcatagcttttccagcttctgaattcaagtctcctttccataggtgtggaattctgtatttctgagcttctggtgggcttggtaagtgtttaataaccatatctaaaacaacttcatgtaatggagctttttcagctaattcatcttgcctgtcttcttcacaatacttgattatatctttaaatgtaattccactcttcttcatgaatggaactgaaattgcccagttgttgtaagctgaaccaaatgcgacacttccatcttcaactctaaccaaccatttgtctttaaattcttctggagccatctttctaattaagttgttaatatcattgataatcttgataaatctgctctgcaactcttctggtgttagttttaactcgttaattaatctatctaccttgttgatgaagaggactggtttaactctctccctcaatgcctgtcttaagacagtttctgtctgtggcataactccctcaactgcacagacaacaacaattgccccatcaatagctctcattgctcttgtaacgtcccctccaaagtcaacgtgtcctggagtgtcaattaagttaattaaatactcatttccttcataggtgtgaaccattgaaacgtttgcagcaaatatggtgattcctctttgagcttcctcttcatcgaagtcgagagctaactgctctccagctaattcttttgaaatcattcctgctccagctaataggttatctgataatgttgtttttccgtggtcaatgtgagcacagattccgatatttcttattctgtcatacttttccattaattccttaattttagcaatcatttttgctctttttcccatgtcccttcaccttatttttagttgttgagttaattaatttgttaaaagtttaaaagcttattgggttattaagataaagtttggatgtaatattgaaaaggcatgtaaatttatcttgctgactgagcaactctctctgtctcttctttctttctaactgcatagcttttctgcatgtctcctcttgcagctgcaattatctcttcagctaatgcctcttcaattggcttcttgcttttatgagcagccatgtatgctccaagagcaatgtttcttaaagcaacatcaattcttctcaatgatgaacaatcaactgattgtaaatagacgatacctccataagaaattcttgttgtatcttctcttggtccagcgttttcaattgcatctactaaaacttgaattgggttttgttttgttctcttttcaatgatttcaaaagcattttcaactatttttaatgcttttaattttttacctgtattttcttctcttctcataactttatttactaatctctcaacaatgttcatttttgctttttcgaactgtctctttgtgtatcttcctgcagtgtgtggaacataaattggtgttaagtttatgtagtttcttaaacctgggtctttaacaacaacatcctttgtgctccatcttccaaataccttaatttcatcgagttccaaattaccacctcatttccaactctttcaaaatttttaataaatttaaatatagagaatttatcttttgattttctcctgtcttcctctaactaattctctcaatgagtttctaccaaccattataaccttatacttaactcctggaatgtcccccttagctcttggtcccttaggtcctccaataccttcaatgataacctcatcgtgttcatcaatgaagtttatagcgtgatttcctggacagaatgcagtaacaactctaccgtttttaattaactgaactctgacacactttctaatagctgagtttggctgctttgcctctaaaccaactttttcaataactattcctcttgccattggtgctccttctaatgggtcatacttctcttttaattttaaaactcttctaacatagttgtaatcgtgccatctacaccattttctttttaatctcaactttctaccagcaaattctcctcttggtgatttacttccactcataatcttcacctttcataattatgttatgttttgttttgattttgagtaatttaataattcaagtaataatttggaaagattacacaatgattttcccatacagcatatagcatataaagataaatacttttataaatacttttactctttaacagtttcctttacatcctgttgaacgtctgtttcttgcttagtttcagtctgttcttgctgttggtctttaactacaggtctttttgctctttttcttttaaatttttgattttcaacaataacttttatttttgtaatttttgtatgtctttttaaaatctttaaagctctttctaagttcttgcctttttctccaaaaaccgctcttctaacttttggatttattttaataaaagcaacaacatcctttccaactcttttaacccaaacatcatctaactgtattggtgcgaatatatttcttataaactttctccagtcgtctgagtactcaataatatcaactttctttccaaatttctcttctgctgttttaacgttctctccacccttcccaattgccgctcctacatcaccctcctttacaataaaagcaactctttcatcatttaatacacagtcaagaatagggacatttgcaattttttcaaaaaatccaatcttcataatctcttctgttgttaatcttaccttagccattattcaccaccttcctttttctctaccagctccataatgtttgagagcccttcatctaaaaccaaaagagcagcaactgggaaaggtttcccacaaaccgctcccagttctaatgatgttattttatgttgataaactgggatgtttgataacttagcgtagtatttgacatcctcttctaaatcttttggaatgtttcctgctaaaactactaacttaccttctccgtgtttaacaaattttattgttctttttgaacctaaaattactttacctgtatctactgcggttctaattgctttattcacatccatattctccctccttctcattttttactccggagggatttcttaggactttcgcaggcaaatatattttaactttggaacttagacatctaaaaaatgtcaatattcaatataaaacatttactcctgcgaaagtcctaactccctaccggtaagaatattggttttcgataatagtttctctatatttatatactttttggataggataaaaacatcaaaaaattaaatcaatttttgtttaaattttttaaaggtcagagaagggcgcgttcatcatcaatattcagcacatcgatgtatcatcatccccataaaatagtagtttatgatgttaatgttaaaagtaaattttaatataaaaactttactcttccatatttttaccctcttcgtactccctatctattgttagttcaacacatccagttcctaagtatattggttttccaacaataacgttttctataacccctttcagtttatcaacatctcccctctctgcagcagcatatagatgcttaacagtttcttcgaatgcagctcttgctaagacagaacctttctctccagcaactccatgtcttccaattggcttaacttccccatcagcagtcattatatctgccactaacatcaaatgccttatatcaacctccaacccctgttgctctaacgtgtttctcatttcattaattatagcgtttcttgctgcctcaatacctaaaacttcttggatttcaatgatgttattggttattgttcttgttgtatcaaccccatcaattttaaacacttctcttaagtttgaaccttgagtatataaaacatattctcctccctcttttttaactaaaaccctctcaattcctggaattccttttaattgtatatttttgatttttgggattctctttctaagagcttttattgatggagtctttatttttaaatataaagtagttccatcaacatcaatctttacctttaattttttcttaattgcctcaataacatcgtctattgttaatcctctatcagctaatctattctcatccaactcaacttttatagattgagtccataaatcaatacttatgctttcagctatacttcccaaggttaaactttcaatctccttcgctatctcttcagctttttctctattatctttatattcttcttttagatagatagtcataattggtgttgatggctcttttcttgcatctacaatctcaatcatccttggcaaacccaaggtaacgttaatctccgcaacccctgcatagtggaacgttctcattgtgttatgagttaaaactccatcaaaggttgtaaatgtctctaaaccttcaacgcttatgtcataaacgtattttttatcacaacttatttcctcaatcttaacaatttcatcccaaattacatcactttcaactgccttctttaacaaccaatactcttttagagctaagatatttactcctttcttaactgccaattcttctattcttcttaagtgtctttgtaatgtagctcttccaattttctgctttctttcaaatttctttaaaattacctttggataatcaactttctctcccaacttagttaatgcatctccaattgaaggaatcatgtcgattgaatcgtaggttttatcatcatttaagctacttacaagcctttctaattcagattttttcttttcaactgagaagttaatttcttcatggaattttttagcatatctgtgtggaattatcagtacaaactgatttttcgtcttagtttttatactaaagatgttaaatcttgccaacaatattgcaattccatcaatcaactcttttgagtttgaagtaactcttataacctttctatctgcatttacatttccatctccgtcaaagtaacctctaattaatcctctaacaaactccttattagctccaaacacaaactcagcaatctttttagtgtttgatgatgtgccaaagtttgataaaaattctgccaatgttgatgaataaatccttatatcatggctttctgcgaatccgttgttgttatcatactctccataattcaaaccaagtttatctgcaaatgctctaattttatttaagataagttcatcaacgtttgaaattgaaacaaagtatttagttactgaaccctctgctaagtagattcctatgaaatagccaaagtcataatctaattttatgttgtttggaatcgatttaccatttatttttggagctattttattgttaatgttatctacaacatagttaccagaaacatagtcggagatgtttatagcctcaacacagtttgcgggtatgtgctttacaactggaattctatctccaatcttcaactcactacccttaactgggattattttgttgtcctttcttataacaaaggagtgatatggtgttgcagttatctccctacctgactttgtctttattttaatcaattttccattatgcttatgtcttatacagcttattatcctcttccaatgcactttttcatcttggtctaagcttaaggcatagatgtcaataggcaaatcacaaacctcactatttccaatcttctcaaatccaaatctctcaatcatctcatcaactaactttccaatttcaactggctttataaactctccttctttgattataatcttttcttcataaggtagagacatctgagtcccaggctctccaatggattgagcagcaacaattcctaccgcctcataaggctcaactaaagcctttctataggcattaacaacctcatcaataatctcatctaccatctcttctgtcaaatccttctcttttgataacttttcaaacaactcatcctttaatgattgtggtatatctaaaccttcaattttttgttttaatgcttccatgtccatgtattctcaccttaaaaaattaaaagatgtaaaaattgttttgaaaaagttttgaaatttttgaatttagagatttattggttatacttcatcttaaccttatcaattattctgtcaatatttactgccttacctctatcagcaagcattgggtcaattccatcctctccatacttaaattgaatcataattcctcttgaatctctaacggttccatcgaactctgtctttaagtcttgtagagcgttaattaatcttctctgcatgtaaccagactgagcagttctaactgcctggtcaaccaatccttctctacctcccatagcgtggaagaagaactctgttggacttaaccccttcttataactacttctaacaaacccgtgagaccttgctcctaaatctcctttttcgaaatgaggcaatactctacccctgtaacctctaaagattctcttacctctaactgactgctgccctaaacatgccgccatctgtgttaagtttaagatgttccctctcgccccagtaactgccatgataaccgcatggttatccaaacctaagtatctctcagcaatagctccagctttgtctcttgcctctcttaaaacattgcttatatatgcctcccttgactcctccaagttcaaacctggaagcaattcaagttctcctctttcatatttctcgatgatttctttaactttctcttctgcctcatctaagactttttcaatctcttttaatgcttcttctggtaaatcttcatcatcaattcctgtagtaaatcctcttaacatcactgcccttattgccatcttagtagctgagtcaaggaattttcttccagcttctggaccaaactctttaactattgtgtgtaagattaaacctgcctctgccccgtaaccgtttttatcaataactcctttaattaactccccatcttttattacaacataggcatcgtattcacattcctcttttttgcacacatcacactttctacaaatctttgctttatatctcaaattcaatccttttggtaatgctttactgaatatcttcttaccggagtataatggaactccattctctaccttatctggctcccataactcatcctttattcccccacttcttaagattaaagtagcttcatcttttgtgaagtagtttgaggttaagagataagctcctgaaataaagtcgtgtatagctccaattataggccctccaaatcttggtgaaaggatgtgtttttctacaagcattaaagcttctgcctctgctcttgcctcctctgattgtggaacgtgtaagttcatctcatctccatcaaagtcagcgttgtagggcgggcaatttcctgttaaaaagccgtttgcaatgaaattgtgagtttctgagattgtagttatatcatagacataatctacttttgtttcttcaatacttacaattttttcttttacaaatccattcttaaggcatttctcttttataaacttatcaaatgtaataaatttggtgttattttctaattttttaatgtttctgtcttttagatatttctcttttgtaaggaggtattcataagcatatcttgctaatgtttcttttttgttagcataggtatatccaattcttccaaagaattctttatggttgtatattgacgcaacataaacttttgttttataaccatcttttcttagattgccttcttcaaccctaacctttaattcaataccaaattcttttagcatctctttaatgtctttaatgaatctatcttcgtcaaatatctcctcaatcttagctattttgaatgataactctttaaatgaagtcccatgatttctaatttttggagttgttaattccgaaccgaagtaggctgataaaaactctttctttatatactttggagcagttttaatccaatttggaatgccatacatctttttagttttatctccacctacacaaccaagggcttttaatagtatgcataacgattttttcctaacttcaaagctataacctttgcctttaattattcttttcttgccgttgtaatctgttatttcagtttctccttcatgtagttttatttcctccccatcataacctaattcttttaagtcctcttttattgtttttaaatcctcaatatctcctctaaatacaactcttgaatttttattgtttattattaaagaaccatctcccattacatgtccaacaatccttgccaatattgatgccttttggtcattgtatgtcaaaggaattaacttcctatcttttagctcattaataattttatttttgtaagttcctccaatgttattaattaccttcttgattttttcttcatcaactattactctattgtcatcttcaaacattgggaagtcgtttggatatattataacttcatctccaactttcaactcaccgcatctctttctaccatttgttgtatagaatggatggtcttctgttgctataatttctcttccaagctctgtttttattttataaatcttctttccatactcatctgcgtttaatttccaatacttgcttaatgaagttagttttggatttaaatcatctgaagttaaaactttgacatctttccatttatcttctaagtccttaattttaattaatttcccatctaacaacactgtggtgtctccatctacacatacgcataaattgtgtctaaatgttctgtatgggagaactctaactctatgtgccataatagacattctatgcagtgatggctgtctgttgtataagacaatatctccatccattaagtgcctttcaacaatatctccttctcttatattctctgcccagaagtctttattgctttcagttatcttaaccttatattcctgctctgttccatctctaccaatcatctttcttataacataattaactcctgggtgtttctctgaaccatttcttaataactgcctaattctctcaatgttgtatttcgttaccttctctgggacggttagctctttagccacaacctctggaactccaacttcattaatacttaaacatgggtctggagagataactgttcttgatgagaaattaaccctcttaccagctaagttgtatctgaaccttccttctttaccttttaatctctgagctaaggtttttaatggtcttccacttctgtgcttagctggtggaatacctggagcttcgttatcgaagtaggtatttacgtgatactgcaacagattccataaatcctcaataattaagtttggtgctcctccttctatattctcctctaatctattgttgattctgatgatatcaactaacttgtgagttaaatcgtcttcacttctctctccagtttccaaggtaattgatggccttacagttactggtggaactggcaaaacggtgagaaccatccactctggccttgcaacctctgggtttaagccgagtaagatacaatcttcatctggaatcttctctaaaatctctctaacatctgatggagttaatgttttttcctcatttccatcaattctgtagtaggttgttggtttctcaaactttatatcatactttatctctccacagtgtgggcagattgtaacttttgaagcttctttataaacctcttcacaaacctcccacttgtttcctccatctctctctaatttttccatcttttccaaaatttctttcctcttagtttcacttattgctactcttccacagtgtgggcaaactgccttcaatatcttgtatattgttttggcaaatcctatatgaattactggtttagccaactctatatgcccaaaatgccctggacactctccaatccttcctccacatgttttgcaaactaaacctgggtctataactcccaatcttgtgtccattaaacctccatctattggataaccatcttcatcataagtgtctggtgtaactatcttagcaactgacatctgtcttatgtaatctggagacaacaagccaaacattatttctccaatctctttagggatttcatacctctccatcaatatcaccaaagattaaggatttgcttttatttttactttttatttttctaaaaatattgtaataaggcaagattaaggttaagcaaggtcttttaatgtttctctttattgtttctgtttaactttttctttctccaatttttcaacaaactcctcaaaatcctctaattcaaccttatctctaaccttaattcttggcaagatacacatactcttcaactcatctaataaaagcttgaatgcgtaaggtattctaacgaatggtatcttcttagagctgtagaggttttcaatctctccacaaattggacagtattttagccctctcttgtagtctaatatggcaaagtctccacattttgaacatatacagatatcatatgggtctgattcatccataagcctctcttttaatagcatagctgcaccatgcccaattaaaacatccctctccatctctccaaaccttagacctccctctcttgccctaccttctgttggctgtcttgttagcacttggacaggtcctctacttcttgcatgtatctttccagctactaagtggtgtaatttctggtagtatgctattccaatgtaaatctctacttcaaacttctttccagtttttccatcatacatgacctctttaccgtgatgcttgaatcctaaagcctctaaagcctttcttaaatcccattctttttctccgctaaatattgttccgtctattcttcttccttctaaagctcctactttacccccaagcatctccaataactgcccaacagtcattcttgatggaattgcgtgtgggttgattatgatatcaggaactattccactctcagtgaaaggtaaatcctcctgtggaactgtaagtcccataactcctttctgtccatgtcttgaagcaaatttatctccaagctctggaattctcaaatctctaactttaaccttaactaacctgtttccttcctttgtttcagttaatataactttatctatataaccttcttccccatgtcttacaacaactgatgaatctcttctctgtggtttaacttgaattgttatctcatgctcctctaagaatcttggtggagaggttttaccaacaattacatctccaccttttacatgggactcaactgcaactattccatcctcttctaagtatctataacactcctctgacctataaccccttactcctttatcaggaatctcaaacctatccatctgtcctcctgggtatcttctctcacacgcatcgtaagttctgaagaaggtgcttcttcccaaacctctatcaattgctgatttgttaaagactatagcatcctccatgttgtatccttcatagctcataatagctacaacgaagttctgccctgctggtcttttatcgaaacctaaaatctcttggtgttttgtcctaacaattggaacttgtggatagtggagataatgccctcttgtatctaatctccattttatattgctcattggaattcctaatgactgcttccccattgctgcagccattgtaattcttggtgctgagttgtgttctggataaggagcaacccctgccccaatacctaatatggttaatgggtctatctctaagtgtgtgtgtttctcagtcaattcttcttcagatagagcaatataggcattttcttcctcttcagcgtctaaatattcaataactccttctttaactaaatctgagaatgtaatttctcctttctttaatttttcaatatgttctttagttagttttggttttccattttctacaactattaaaggtctaacaatccttccagcatccgtgtttatatgaatgtcattactttcttcattgtaagcaactgttgtatattgagggagctctccttttcttcttttttccctaataaaattaacaagttcttctggtttgtctgtagttccaactaactttccattaacataaatatttacttcccttgatgccaagtttttcacctaagagagatttttattgattttgaaaagattaaaattaaacatcaacaaaaactcagaaaaaacataataaataaagtttcttttaagaaacatttattccaaaggattttaatagctcaataactttgctatcatcttcttctcttgtaactttacacattatagcaaagtttttaacaagaccacagtttggaccttctggagtttctgaagggcagattttaccccaatgagttccatgcagttctctcgcttcaaagtgtggctgtgaccttgataatggtgaaactattctcctcaattgagagtttgttgctaagtaacttgttctatctaagagctggctaaccccagtttttcctccaacccatgttcctgttgccatagcgtgtttaattctctcggttaatatatcgctccttacagcagcttgaattgaaggagttttgttccttaatgtttgtctctctaattgatattttatatccttaacaagttggctaaacgcatatctaaacaaatcttccattaagtccccagctaatttagctcttttatatgcgtagtggtctttatcatcttctcctctatatccaaagtaaagttctaaagcgtttcttgccattattcctaagaacctaattttctttgggaaatcttcttttgtaactcctaaatggggcagtaaatagttacataaaactgtttctgctctctttaatctataatcctttgcctgccctggagctactctctttccaataaactccaaagcatcttcaggggagtttatgttatgctcttccctaatctcttgaatgtttaaaacaatctccataaagaatctttcatcatcaattgactcaatgatatctttatctgtctcagccccaagtgctttcattaatataaccaatggtatctgcccaggcattccagggaatgtagcatacaacaaaccatctggatgtctttcaacagtacataaagccctaaatccgtgtcttgttgaaaacacttttgcaacatctactatctttccacttctctctgccttctcacataaaattctatttggaattaaatcttcctgagtaattaatactttttcagttccattaattataaaatagccaaatgggtcttcagggtcttctcccaggtctataagctcttctcttgattttccatacaagtggcagatttttgaaccaagcattactggaagttctccgatataaacttcaacagtttccccttcccttgcatcttctccttcaccaataataggggtcatttctaaatataatggaactgaatatgttaaatctctgattcttgcttccattggagttattggtcttattgaaccatcagcttctttaataactggttttcctactttaattttccctaatttaactttataccctccagtaatctctgtttcaatatatccaacttcatcaataattttttgtaatctattttctacaaaatcgttgtatgactctatctggtggtctattaaaccatgttctttaaaataagcatctactaattctctcataattgccacctattttttaaataatccttttaataactaatctataagctatactaactccagccgttggactttttctaattactctaacaacatctccttctttagctccaatttcctgaataacagggtcgtcttcataaatttttggtagttgctgaatctttatattgtatctcttcaaaatctcctcaacttcttcttttggaactatttcatgctttggaaccagtatgtggtctgtgaccttcaaggttactcctccctaccattttgtttaaatataattaatgacaaaaattaggttaaaagagagactcaaggtaatgatgtaataaatgtgatgcatccttacaaatatttttttctcatatttattttttacttttattgtcctataaaaatatttctttatttgaatattctgttaattttttatagctactttagccttctttttagtcccttcctttagatttttaacaaactcctccaactcctttaggaatttttcctcatcctttatttgtccattctcatctaaatgtttttcaacaatcttaacaatcgcacttcctacaatagctccatcagctatttcagttatttcctcaacatgctccctctttgagattccaaaccctacacaggcagggatttttgaaaactttttaactctcttaattaactctttcgtctcttcagctactttctctctcgctccagtaatcccagttacagaaacaacataaacaaacccactacacttttctaaaattttctttaacctttcatcaggtgttgttggggcaactaaaaatattaaatcaactccatactttttacagtaattgtataagctatcagcctcttcaattggcaaatctggaactataatcccagaaactccagcctctttacattttttaacgaactcctcctctcccatcttaaatattatgttatagtaggttaagaacacctttggaacatttggagctttttcattcaattttttagccaactcaaatgccttcaatggattcatgccactgtttaaagctctaacatctgctttttgtattgtaattccatctgcaacagggtcagaaaatggaatacctatctcaacaatatcagcatgcttacaaataacttctaatgccttttctgaaatttccaagtttgggtctcctcccacataaaatgcaacaaatgccttttctcctttgttttttaactcttcaaatttttctgctaatttcataatcatccactccaactttttagtaaaagctgcccgaacaacctttttagaaaaggttgatcaaaatcttaatttaaatgggtatcccaatagggcgaagtcctatggtgtcttgaccagaacggatacattaaagggcttttagtccctttaatgtctcttaagattgtctcaagtaatcgaatatgtctttaaatctcccttcccaatgccttagcaacagtctgaacgtccttatcccctcttccagacaaattaataaccattatatcatctttatctaatttatcagccaatttaacagcataagctaaggcatgagaactttccaatgctggtaaaataccttctaacctacatagcaattgaaatgcctctaaagcttcgtcatcagttacacaaactgctttaatccttccctcatcctttaaaaatgaaagctcaggtcctactccaggataatctaaacctgctgaaatactgtaactttcttctatctgcccaaactcatcctctttaacataaatcttagctccatgcaaaactccaacctctccagcacataatgaagctccatgcattccagtttctatccctttacctccagcctcaacagcgtaaagctctacgtcatcatccaaaaactcataaaatgcccctattgcattacttcctcctccaacacatgcaacgataacatctggcaatcttccctctttttctaatatctgctctttaagttctttaccaataactctttggaattctctaaccatcattgggtatggatgaggtcctaaggcagaaccaagcaaatagtaggtagttctaacgttggttgtccaatctctcaaagcttcatttacagcatcttttaatgtctgtgagcctccaaatactggaataaccttagctcccatcaactccatcctaaaaacatttaatttttgcctttcaacgtctttagctcccatgtatattatgcattctaatccaagctttgcacatgctgctgcagtagcaactccatgctgtccagctccagtttcagctataactctctttttacccatctttttagctaacaaagcttgtcctaaggcgttgtttattttatgagctcctaagtgtgctaaatcttctctctttaaataaactttacaaccaagttcttcactcaatctctcagcataatataatggtgttggtcttccaacgtaatccctcaataaagcatagaactcttctctaaagtttccttcattgtttatccaaaatctcttaaatgcttcttccaattcagctatggctggcatcaatgtttctggaacaaatttacctccgtaaatgccaaactttccattttcatctggatacatgtctttgtatttcttcaagatggacaccccaaaaagataattttagcttctgaaatagtatttggtagtaatacttatacgttttgaacttaatgcaatgcaatgattccaaccaatatatagcccaatagaatatataagaacgttttttcctctttatgctcatagatatgaggagcaagcataagaaacgctcctaaaaacacccctccagagaatgccaacagtatctttgtagatacatcctttaaagtcaccaatccaactatagtgccaaggactgttccaaatgacacaaaaacccctggatagagaggattcttatagacaccttttagtggagatatcaaaacaaatccagctgggagtttatgcatcaatatagcaagatacaaaggaagccctatctcacttatatatgatacagcaattatcaacccatctataaatgtgtggataaagaaggatattggataaataaacttaatcctattttcttctaagttgtcacactctacacaatatttttttgataatgggcagtatgctaaatatttttcaataagatagactgtaatcatccccaaaattacatataacacaaacatgttggagtatgattttggaattaatattagagttgccactccaaatataaatccaaaggaaattgcctcaaattcatatttatattttaaagatactgagtagtaagctaaaagctcgccaatacacatgacaataaagcttagaattgcaataaatattggaacctcaaccatgtttgacacctaaattttatattttatcttatattaataatattccaacaaaaaccggatttaaacgttaatatcattcacattattttatttttgttaatttaaaaattcaaattgtataattaattaatatttgtagaatatagccctaactcatttatgcccatgaagcaattatacaaaagctaaaactttggttattaatgttaatttctgactattctcatatttatagtcatttatagttattagattttctaatatataacttaaataaaaataatagttattattttttaataacaaaatctaaagatattatatatcaggtgaatattccaaataagtagtaagatatttattggataagcttggataatactaatatccctattaagtaataaaaaaggtgataacttggtcgtaaaaataggaataataaagtgtggtaacataggaatgtccccagttgttgatttagcattagatgagagagcagatagaaaggatatagcagttagagtcttaggtagtggggcaaagatggacccagaatcagttgaagaggtaacaaagaagatggttgaggaagttaagccagacttcatcatctacataggtccaaatccagccgctccagggcctaagaaggcaagagaaattttaagtcaaagtggaattcctgcagtgattattggagacgctccaggattaagagttaaggatgagatggaacagcaaggtttaggatacataattataaaatgtgacccaatgattggtgcaagaagggagtttttagaccctgttgaaatggcattattcaatgcagatgttataagggttttagctggaactggagctttaagaatcgttcaagaggcaattgataagatgattgacgcagttaaagagggcaaagaaatagaattaccaaagattgttattacagaacagaaggcagttgaagctatggaattcacaaacccttacgcaaaggcaaaggccatggctgcatttacaattgctgagaaggttggagatgttgatgttaaaggttgtttcatgacaaaagaggcagagaaatatatcccaatcgttgcctctgctcatgaaatgattagatatgccgctaagttggtagatgaagcaagagagttagaaaaagcaatggatgctgttagtagaaaaccacatcacccagaaggaaagagattgagcaaaaaagcattaatggagaaaccagaataaattaatcctttttaattctattttaattttttccttttattattttgcaaatctcttttagtaactgcagtttatttcctttataatcaacctctacacatccacatatctcccaatgttgtcttgggtatcttttatccctataaatctttggttctaagccaagtttttttaatgccttttcaatatcctttaaagatggcttttctatagctaactcttctggaacttttcttccttctctcctacttttctttttatctatataagatggccatataatcattttctccctctaaatccatcctgaccttctaaatatatagacaaatatcataattattacaaccatcaaagccattacaagccaaaaaccttgagggttgtttgctaaaggtaaataagagaagttcatcccgtatattccagtaatccacatgggaacagcgaaaattgtcgtaaccatagttaggattttcataatttggttcatctttatattttctaatgagagggttatatccatcattgaggttaaaacctctctataggttgctgacatatcaattaactgtaaagtgtcgtagtaaaggtcttcaaagttctctctgtcttcttttgtggttattggaagatactttctctttaataaaactaagacatccctattagctattaaagatttatgaaaataaaccaaagtttttcttaatcctaaaattttttccataacctctctgtcatagccagctaataatttatcctccaactcctccaactcatcttctaaattcattaaaattcttgaataactccttgtaatctcatttaatatatggtataataaaaagccaattcctctttcaaatacaattcttggtttttttgttgatattaatttatgcaatcttccaatagcctttattttatccgagtggattgttagtaggaggttattcttaatatagatacctaaggatgttgttgtaatatcctcttcaaataatggagctttgtaaataattaagtaaaagtcctcatcttcctctacccttggaatttcctgctcatctaaaccaatttgtaaatcagagacagaaataccaatttttttagagagtttatatagctcttcatcttttgggtcataacaatcaatccaaataagtctataatcttcaaagctaatttcatcaagttttggctcgacaatactgccatctttagctatagcaattaccgtaatcatattagccctttgtgatgctattttttaattttttgaatttatcttcttttgaactttttgtaaataggataactgaaagaataataacaatagatatgtaaattataacacacataacaaacattataaagcttatcttttttagtaggtattccccaccagaaataatcagttctctcgatatgaatatacatatcaaacagaaaaaatactttttaagtatttctaaaaggtctttttctgagttgataatggtatctacaaatttcccaaccattaaaatcaacaatgaaagtgttaaagaatccacaaagtgcaataaaaattctcctataaattctgtaagtgttgatgaagttttattaatagaacttaatgagtatattagtccaataattaaaataaatatagatatagatgcagagataggaaaaaccctccctacatcaaactcttctttctttttaattttctccattaataactttctaacacccactccttccgataatatatataacccaataattccaacaacaattctccaacctatatctgcaaatatcgcatacaatattaaagaaaatccaataaatgttaaaattaatgggatatattcttccatggtctttttaataaactcttggattaaataataagtggattctaaggtttcactctgcttaactataactctcttcttccacacaaaaatattttttgactccaagtattttaaaatcatctcatcctcttttccatcagataccaaataaataaaatctggattatacagatataacaaaaagtctatctgctcctttattctcaatgcacatttctctgattcaacatcaacatctccagaaattgtagctatttcaacatcttttccacttgcttttaactcatcgtaaatcttaacccctccaagaattgcattaacatcgctatctccagggtctgccaaacctaattttatcaatgcctttatgttttcctccctacctaaaattggtgtgtttagaccagcttttcttccaatatcgtcatcaatatcaacaacaagaacaagataattttttactccttccttttccatccttactccctctcataggcaaataatgataaacaagataaacaatgccaacattcttaaaaataacagataattatagttacactatttaatgttatatataccttttaattaattaaaaattatttaatttaataaaatccatccccaaagggcaatgactaatagagagaaagttgttgtaataaatatagatgaagctatcaatttaatatctaactcatataatgtccctaaaacgagcgtcatcattgctgaaggcatagaactctcaaccaataaaacattcttctctaaaccttttatattgattagttcagataacgtaaaggcagtagctggagatacaatgaatctaaatattgacgctataattccccaaaagactccaaactttaaagcctttggtgagagagataaacccaaagacatcatgattaaagggacagttgctgaagatagataatttaaagattttaagataaagcttggaatataatttaatttaaaaccaaaaaatactaagattattgatagaattccagttattaagggagggaatttagccatatcttttaggatgcttttatctctaccttttccaaatcttatcccaacataagttcctaatagcattgtagcaaaaactcctcctaagtcgcagaatatagctcttgccaatccctcttcaccaaacattcccaaagctactggataacctaaaaatccagtatttccaagcattgataccaaaattaatcctccaagcttttcatcctttaatttaaagatgtgctttccaagtaaataagccaatatcccaacaaataaacagcataaaaaaatgaccactggaagctttaaaaattctaatatctgagatgaggagacattttttgatatagttaaaaatatcgttgaaggcatagcaatgtaaataacgatattgtttaaaatctttgcatgttcttcttttaaaatcccaaagatttttgaaaaatacccaactaaaactaaaattaagacaattaaaacaacatccatgggtatcactttattattctcccctcttcatctatctctccctttctaatcctcgttgttgatattggctttccatcttcagctaatataggtttgaagataactatctttaatggctttaatcctttagactctcttattttgtttattttctctgcattttttagtgtttcttgagtaacaactattatatcgtaatcttcagttattgcatcaccataagcatcatttataactttaatttcataatcagctttaatactatccaaaaacttttttaaattttctattcttgtttttaaatcatttattttatgtgttttatattttttggcaaattcatcacttgttattcctatagttaattttcctaaagaggatgcaaattttaaaagctccttatgccctctatgcagaatatcaaatgttcctcctactactaccttcatggctataacctacccctattttgcagaaatctatagaattcatttgagagattaactatatctttaacagagagtttaaaaaccttctcatttattaggttttttatctctgagtttgtatttaaaaaatcttccaatatctttttcatttcatctttgttatagtttaattctttggaagaatcaatcaacgccttcctaactgatttatttctatgttgaaatatagctctcaaaaaatcatcaaagaaattttcattctctatgtggtatttgcctttgttaggttttattttaactattgcagaataaacctttggttttggatagaaagcacttggtggaactttagctactatctcaacatctgcccttgattgaaccgccacagataaccttccataatcttttgttccctctttagctaccattctcttggcaaactcatactgatacattaaaacagctaaatcaaagcccctctttatcaatttaaatgttattggtgatgaaatttgatatggaagattagctacaaccttattaaaatctaacttgtttaaatcaacttttaatgcatctccccagatgatttctatattgttataaagctcttttaatttattagcataaggctctaagcttttatctatctcaatgacatagacttttttagcatttttagcaagctcttctgttaaaattccttttcctaagccaatctctaaaactacatcatcctttgtaagatttgcagattccactgccttattaacaaaattcttatctattaaaaagcattgccctaattttttctttggtttgaacattgtttcactttttatttattctaaaaaagagaaaagaaaataaaaatttattctaacaacttaacaactttctcttcaatctcatcaactggtttatttaatatattagccaatgcctcagcaaatattcttgcatacttcataacatactttctctttttctcttcttcagcctctcttctaattcttgataaatatttctctaattctctaccacaaatcatcaacgcatgtctaatttcattataaatttcttcattttcattttcactacaagcaactgcctgctttcctgctgaagtgtaagggataaacgtagatattagattaacaaacactgttattggtgcatcttctcctctcaacccatacctcttccaatttatactcttaactgccttagttaaaccacaggctgaggcatcatacagcaaaggaacgtggttagcaaatctcataatctccattcttcttccttcgtctccctgcctcccagcgtttcctccataggcaatagcaacttcaacagcgaatggaattcctcctttataagtttttggatttctcgtaattgccttaacaaaatctggctgtaaaagctcttttaatgatttttctatattctctgctccaataggtcttaatcctgttgttggaggagccataaattccatactttgaagacaattaacaatcatttccgcctcatcccaagttaattccttaggatttttatttaatatgcttttgacttcatcctcaaatttttttagttcttcatcagatattagtcctttattttttatttcagcgataaattcttctggatttttaactatatttttaacttttttgtttaattcatcaacaactgtagctgataaatagttcttttcagcccattccataaagttttcaggtatcttcttaaagtggttctttaacttgtttatctcctcttcacttagcttattaaataaatattccattgttatatactttaaagcgtatctctttaattcatctaagctctctggaaggtttttaattaacattctaacggtttctatctcatcatcggtaatataatctttaaatttatttagatagctctcaatatctatatttaaatagcaagaaacaaccatgttccaaaatacactatctttaaatttctttaatattaaatctctaagcatgtaatttataagctctttaattctttttgttgtaactcttgaaagttcagagacgagcattgaagaaactttctttgattttgtctttcttgcaatatataatagttcatcggtagttaaaccataaggatgaggtttcatctcctctggttttttaggcagttcattaacaaccctatcaaatacaacctctccataagggtcttttaatacaatttttgcgtgtggtgttgctaaacttattctcctcaaatattcaaaaggtccaaactctcctctgttgtagctaacttctttaaactctccctctactcttgttcctctccattttccttttcttactttttttgatacaatttctccttcgtttttctcaacattcatctttacttcaacttcatagatattgccatctccagttgatgttataatttttaacggctttccagtggttatttgtgaaaatagcagaactccagcagccccaattccctgctgtcctcttgattgaataaacctatgcatcttagaaccagctaacatctttccaaatacctttgggatgaattctaaaggaattccaggaccgttgtcttcaactgccactttatagtggtcagctcctaacttctcaatctcaacttttatatctggcaaaatgccggcttcttcacatgcatctaagctgtttgtaaccaattcatggattatagttgttaaacttctaatttttccactgtatccaagcatgtgtttatttttcctaaaaaattcagcaactgaatgttctttaaattctttaaataattcatctcccatgaatcccaccattaaacttattttgcaaattaagcttttatgttgaaaatgatatataaaatttaaaattgtcatatttatatttatcaataaatatcagtaaaataaataatgtaacaaaatagaaattaactaaactatttttaaactttaaatcttattttctttaacaacaatcatcctatctgtgcaagtaaagcatgggtcacagcttgctataattaattcagcatctgaaacatgatgtcctggcagaattgcttccatacaagctaagttggttgctgttggtgtcctaatttttacctgtctaactctaccattttcatctaaaccataagaataataaacctgccctctttgagcttcattataaacatctattggtttaaactcctttaattcatagtttgggttatatattcttttatccaaatttggcaagtcctttaaaccctgtctaatgattttaacgctctcaaaacactcataaaatctaactgccaatctgctaaatacatctccatcatcaaacacaatctcttcaaactcaaagttatcataaacagggacttgtcccatctttctcatgtcactatgtattccagaacctctcgctgttgggccaagagcatggagttttttagcagtttttttatctaaaacaccaacatccttaatccttgacataatcattgggtcattaacggttctttccaataatttctttaaattttcttcaaacttttccaacctctctaataaagctggaatcttgctctcttttatattacatctcggcctaattcctcctattatagggcaagagtattgagccctccctccagtaatctctcccaatatttgcattattggttctctaatcataaaagctctgaaagccattgtttcaaagcctaaaacctcaaaggcatgtccaaacagcaacatgtgggaatgtaatctctccaactcttcaactatagcccttatatactcagctctctctggaacctctatatcacatcctctctcagtaactgtaacgttacaccatacatgaatatgtgagcaaataccacaaatcttttcagataatatactaattttttctggtggcaatccttccatgataagctcaattcccctataattaacaccaattactaattcagcctcttttataatttcatcttcaataaacaatcttaacctatgtggttcaagcattgtaggatgaactggacctatagctatctctccctcatacttcatgaacaacacccaacaattataaacatgataataggtatatgactcactaaggtaatgaatagataatttatcataattaataatgataattagcttaaccttttatatagttttgttttaataaagttatcgagatgcattattattttattacaaatctggtgattgttatgactcaaatggatgatgcaaaaaatgggattatcactgaagagatgaaaatcgttgctgaaaaagaaaaaattgatattgaaaagcttagaaaacttatagcaaaaggatatgtagttattttaaagaatgttaatagggatacaaatccagtaggaattgggcagagtttaagaactaaagtaaatgcaaacattgggacgtctccagattgtgttgatatagaattggagataaaaaaggcaaaaattgctgaaaaatatggggcagatgcagtaatggatttaagcactggaggtaatttggaagagataagaaaagcgataatggatgctgttaaaatccctattgggacagttccaatatatgaagttggaaaattggcaagagaaaagtatggaagagtcattgatatgaatgaagatttgatgtttaaggttattgaaaagcaagctaaagaaggagtagattttatgactttacattgtggtataactaaacagtcagttgagagattaaagagaagtggaagaataatgggagttgtaagtagaggaggagcatttttaaccgcctatatcttatatcacaacgaagaaaacccattatacaaaaactttgattatttattagatatccttaaagagcatgatgtaactataagcttaggagatggaatgagacctggttgcttagcagataacacagatagggctcaaattgaagagctcattactttaggagagttggttgaaagatgtagggagaaaggagttcaatgtatggttgaagggccaggacatattcctataaactacatagaaacaaacatcagattgcaaaaaagtttatgtaaaaatgctccattctacgttttggggccgatagttacagatatagcccctggctatgaccatataactgctgcaattggtggagctttagcaggctattatggagctgatttcctctgctatgtaactccaagtgagcatttaagattgcctacaatagaagatgttaaagaaggagttatagctactaaaatagctgctcaagctgctgatgttgctaaagggaataaattagcatgggaaaaagagacagagatggcttatgcaaggaaaaaccatgattgggaaaagcagtttgaattagcaatagataaggagaaggcaagaaagatgagagaagaaattccatcaaaagaagaaaaggcatgttcaatttgtggggattactgcgctttgttaatggttgaagagttaggaaagagataaaatgtggtgtctattatgaacaaaaatgaattaataactgaaattttaaaaaatgaggtagttaaggcgttaggttgcacagaagttggattaattggttatactgtcgctaaggcaaaaccagaggatttgtattcaataaaagagattaaattaatcttagataagggaacttttaaaaatgccttttcagttggtgttcctaacactaataaatttggaatattgccagcagttgttggtggtttgttaggaagggaagagaataagcttgaagtattcaaagacataaaatatgatgagaaattagaagaattcattgaaaataagttaaaaatagaagtaattgattcagacgtttattgtaaagtaattataaaagctaataaagtatatgaggcagaaacaaaagggagtcattctggaaaatctctatctgatgatttaaaaaatgcatacaaaagcctaactcttaaagatttcattgattatattgaagatattcctgaagaagttattaaaattattaaagaaacaatagaaactaacaaaaacctctcaacgccagaagttccagaagattttattagcttagatttaaaggatgaaattctaaatcatatgcttaaaaaaacagtttcagcagtttataatagaatgataggtatcaataaaccagccatggctattgctggtagtggaaatatgggattaacagctactttaccaataatcgcctatgatgaaataaaagggcatgatgaagagaaattgacaaaatctataactctatcagctttaacaactatatattcagcatatcattcatcctacatctcagcaatgtgtggatgtgtaaatagaggaggaattggagctgtttctggtttatcctattatatatttggatttgatagaattgaagaaagtattaaaagctttacagcaaaccttccaggaatcgtttgtgacggaggaaaaattggctgtgctttaaagatagcttctggtgtctttgctatatatttatctttattctccaaagtgccatatacaaatggaattgtcggaaaggactttaaagaatgcatagagaatattggaaaaattgggaaagcaatgaaaccagtagatgatgagataatagagattttgaaaaacaagaaataattattttttaaagataatttttataactctttttaatgttagattttcttcatacagcaaaacaccaattttaaacagcttaattgataagataaaggatattactatactaacaatcataattgctgttgataatacaatttctattaaaggtagctgagttacactcgctctcaaaacaactgcataaggagcagtaaatggaacataagaaagaattttagccatatagtgatttggattaaccattatcgtgttcataaacattattggaataatttggatgattattattggagatattaattgagatgcatcttttggatgagaaaacaaggaagacaacccgcatagtagagatgaataaaacaagtatcctaatacaaaataaatcaaagcaaagattgctaaatacagagagactttaactgcataagttattattataggtaaagcaaacaacacccaaattcctatttgcaataaaccaacagccgaaattcccagtattttaccaaacattagattttcagctgatgaatagcaaagcaaaagctccataattctattttgcttctcttcaataattgatgagacaataattcctgatagtgaagagatagccatatacaacaagaaaacaaatccaattggcaataattgagataaaaacgtctctttttcaaatccttttttagatacagaataaatttcaagattcataggatttataactctattgtatgttttattatcaaccttaccttttaaaagcttttttaataggaatttatttagagtatctgtaattataggatttggtgattttgttgttgagtaaagtattatttttccagaatctaagtaatcttttggaataactattaaagcatctatgcttttatttaaaacatcctctttgcctttttcaatgttttcatattttataaaatatatggttgtattttttccaaagttattttctacaactttatttggaatacctaagccaaattcatcaacatagccaacttttatctccttaatgtcaaacatcataaaacttccaattatcgctaaggcaattataattaaaggccctataatagtagctattaaaaactgtttcctttttatattgctgagaacttctctttttccaatagttaaaatttttttgatattgagtttcattatatcaccactattcatctaaaaatagatcttccaatgaatatctaacctcaaatttaattacatcttctgccttttcttttaaaattaaaacagcctcttcataaggaatctctttctttattaactttccgttatctaaatactcaatgtatgccatttttctacagatatcttcaatctttccataatgaactgctttccctttctttaagattaaaactctatcacacaacctctctatcttttctaattgatgagttgatagtattattgtttttccttcttcctttagctcaaatattatatctctcagtagtctaacattaacaacatccaacccagaaaacggctcatctaaaataacaatatctggattatgaataactgaaacaataaattgaactttttgctgatttcctttagatagttctttaatttttgagtatttgtaattactaatttttagtttatttaaccagtaatcaatacttttggcaatctcttcttttttcatcccagccaattcaccaaaaaactttaatacatctacaactttctcatccctataaagtcccctctcctctggcaaataaccaatttttccattaacttctacatagccagtatattcctcaataatccctgccaatattcttaaagtagttgtttttccagctccattatgccccaataatccaaaaatctccccttcataaacttcaaaagaaatctcatccaaaacctttttatctccaaagtattttgttaagttctctaccttaatttttggtttcataatctcccaacattaattttattaatggtgattattaatattcttttgagttttaaaattaaagttgttgatgtgataaaatgctcgaaccaattgcctatgatattggaagactgtgcaaagaggaagataaagaactaacccctaagctaattgacattgatgtcataggactttcgcaggaaaaaattttttatggtataatgacaccttttaggtgtccaaattccaaatccatatatgaactgcgaaagtcctatgttaaagctgatggcataaagatgccttttgatacatttagagaactaacctcaatatttaaaaaatcttttattggaactgttaaatataagggtaatgtatttaaatatcaaatactaaactttggtaagcacgttgatttaattgaattggaagatgctgatttatatatcatagcagatggtagaaggttgatagaaagaaaagaacttcaaataataccaaaaattagagaaaaaatatctccaaactcagctatttactccccagctgtatttccttgggaaattccactattggcttatataggcgttgattactttgatgactcattagctaagttatatgcatcaatgggctacaaatttacaaaaaatagggctgtaaaggtagatagctttagttttgaggaattatataataacaataaaaaagtttatgaggaaatcttagaagaagttaggatagctataaaaaatggatttctaagaaatgttgttgaagaaacagctgtatctcatccatatttgtgggcaaattatagaagatatgagccagatttaagaaacatcccgttatcaaaagaaaataagattattgtaacaaccaacattaatattccagaggttaaaaaatatttggaaagattagataactatgagccgtattcaaacattatagttttattaccttgctcatcaaaaaagccctactcaatttcccaatctcaccaaaaatttataaaggcgataaaatctgcaaaagttgttgttgaggaagttatattaacatctccctacggattagtgccgagagctttggaaaggttagtcaattatgacattccagtaactggagaatggagttttgaagagatagagcttataaacaactgtttaaaaaacttcttaaagaaggttaaggagaaatttgatgattatattgttatagctcatcttccagaacactaccttgagattttggagttggatgatattgttattacatcaaaaggaaatccaacatcagaagaagctttaaaaaatttaactgacacactaaaaaagtataaagaactaacaaaaagtaaagatataaataaaaagggacaaagaattcataatattcagcaacttgcagagtttcaatttggcataaactttataccaaacgaaatatttataaatcataaggggcaaatatttacaaaaattaacaataaaaatcaacaaatagcatcaataaatccaaaaaatggtttgcttatcttaaccttaagtgggggagagttgttgtggaacagtgggggaaaagacatcaactatattgaagtaaattatgaaattaaaaaaggttctctctttcctcccggatttgttgattgcaatgaaaatatttcctataatgatgaagtcgtcttaattaaagatgatacatttttagggattggaagagctttgatgagtggttttgaaatgaaaaaggcaaagcatggagctttagtaaatataagaaatgttaaaagctgacctcctctccgagctaaagctcggaggttcccacggggaacacccttctccctaccgtcgccggtaggtcacagggcaggttcagctcatcgggctgggtcagacagccctcaaataaaaattatacactaaatcgaatatataaaaattatgcttgcttattcaccttcctaaatcccctccgagctaaaacattggagttttcttaacaacaattaatggtgaatagttaatggagattgagagagtagctgagctaatattattaaaagataaaaattttaaagagaaagaaagactaagagatctattaagggaatatataaaaacaaaagatgaaattagttatttagaaaatatccttgaagattttgaaaatttggatgtaaatttaaaacatctcaaaagagatgctgatattataaaatcaatactgccaagattaagtaaatttacaaacatcccagttttcatgaaaatcgttaaaatgttagaggcagttgaaaaaattgatacagaagatcttgaatctgtgagatggaacatcaataaggaaatagaagagctaaatgataaacttaaaacacttgagaatgaattaagggttataataatcaatgaagcattatcaaaaataggtacttcgaatttagaagagttttcaaaatatttagaaaatctgaggtatgaagaaaaaaatcaaaaagaagaagcgtataattagtgtcttattattttaagaatttttgaaagacactataaaatttttaaattgtaatttcttcaaatacaggtttttctttttcaactcttgcatatacagagacataattttttattccactccattttattttctctcctaaaacctcttggatttggaatatcccagcttcatttgatagtattacctcaatttgtattggcttctcatcgccctcctttatttcaactctttcaattgaagccgctgaaactgaatgtatatcatagcattttttacagattggaattcttgaccttccctttgtcatatctgttccatctgcaacggcaataactccagcttcaatcgttaatcccataattccttcactgtgagaataaatagcgtgtaaaacctcagtagtcatctgataagctttctcttctttataatacttttttaatatgttttcaactatatccaaagccaaatatgctgaatgtaagtgatgaatatctctatgcactgaatttccaatatcatgcaaataagctcccaaaagagttataactaaagaatcttcaaaactgcctttgcagtcttttacaaaacttggctctatcccttttttatataaaatttttagcatctttattgcattgtttgccactatcttagcgtgtgtttttccatggtcattgtagcctaatctaccaacagccatgatatttgacatttttaaaaaagtatttacctttttatttttaattagttcatcataaatcatttttggaatcccttgtagagaatttagctcttcgaagtccatatctctccccatttagataaaacttgtttttaatttaattaaaataatttaaatttaaaattaaattaaccttcaaggcaataaaataaaaatattttttagaagtttatttcctatccttcagcttaatcatctcatcgaataaaaacattgtgtcatgaggtcctggtcttgcctctgggtggaattgaactgagaatattggtaaatccttatgcctaataccttcaacagtcatatcgtttagatttataaagctaacttctacatcatctggtaagctctcctttctaacagcaaatccatggttttgggaggttatataaactttttgtgtttttaaatctttaactggctggtttcctcccctatgcccaaacttcatcttgtatgtttctccaccaaatgctaaggataaaagttgattacctaaacaaattcctgttattgggacaacaccaattaagtttttaatatttttaataacttcttttaatcttgctgggtctcctgggccattggagattaaaacaaaatctggtttgtattctaagatttcatcatactttgtgttgtatgggacttgaataacttcacagtttctttgaactaaacttcttataatattcaatttaactccacaatcaattaaaacacatcttgcctttgggttagctgttttatgaatttttggttcttttgttgaaactaaaggaactaaatcaatatctgatatatcactgtatcttttaactctctccaataattcagatatttcatcatcacttatttcttcagcaacctttaaacagcttttaacaactcctttatccctaatctttcttgttaagaatcttgtatcaatatcttgaattcctgggatatcatactcctttaaaaagtcatctaaagctttacttgttacctctctaacaacaaaaccctctgcctttatcccatctgactcaaaccaatcctttttaactccataattcccttctaatggataagtcatcataactatttgccctttatatgaagggtctgttaaaacttcaacataaccagtcataactgttgtaaaaactaattctccaaaaacctctttctctgctccaaaaccttttccttttaaaattgttccgtcctctaagattaacactgcctccatatatttcaccaaaatacctataaactatcacatatatatatgattgggataatcatctatctactgcttttagaggacattatgcattttataatttatggttgttaataattgatgaaatggtgaatagacatggttaagatattagttacagacccattgcatgaagatgcaataaagatattagaggaagttggagaggttgaagtagctactggattaacaaaagaagaattgttagaaaaaattaaagatgcagatgttttagttgttagaagtgggacaaaggtcacaagggatgttattgagaaggctgaaaaattaaaggttattggtagagctggagttggagtggataacatagacgttgaagcagcaacagaaaaagggattatagtagttaatgcccctgatgcttcatcaatctctgtagctgagctaactatgggattaatgcttgctgctgcaagaaacattcctcaagcaacagcatcattaaaaagaggagaatgggatagaaagagatttaaaggtattgaattgtatggaaaaacacttggagttattggtttgggaaggataggacagcaagttgttaagagagctaaggcatttggaatgaacataattggttacgacccttacatcccaaaggaagttgctgaaagtatgggagttgagttggttgatgatataaatgagctatgtaagagggctgattttataactctgcatgttccattaacaccaaaaacaagacatattattggtagagaacaaatagccctaatgaaaaagaatgccataattgttaattgtgcaagaggaggacttattgatgaaaaggctttatatgaagcattaaaagagggtaaaattagagcagcagccttggatgtgtttgaggaagagccacctaaggacaatccattattaacgttagataatgttataggaactccacaccaaggagcttcaactgaagaggcacagaaagcagctggaactattgtggcagagcagataaagaaggttttgagaggagagttagctgaaaatgttgtaaatatgcccaatattccccaagaaaagttaggaaaactaaaaccatacatgttgttggcagagatgcttggaaacattgttatgcaggtattagatggttctgttaatagggttgaacttatatattcaggagaattagccaaagaaaaaactgatttaataaaaagagctttcttaaaagggcttttgtcaccaatattattggctggaatcaatttggttaatgcccctattatagcaaaaaatagaaatatcaatgtggttgaaagctcaacctctgaagagaaatatggaaatgctataaaaataactgctgaaagtgataagaaaaaattctcaatagttggggcaataataaacaataaaccagttatcttagaagttgatggatatgaagttagcttcattccagagggagttttagcaattattaaacatattgatagacctggcacaattggtagggtgtgcataacattgggtgattatggaataaatattgcaagtatgcaagtaggaagaaaagagcctggaggagaaagtgtaatgctattaaacttagaccatacagtccctgaggaagttattgaaaaaataaaagagattccaaatattaaagatgttgctgtgataaatttataatcattattatttgagtaccatgtctccaatttcaaacctttttagttcagagatgctcatcctatcctttaaaaactcttttggaatcaaatataaaaattttggatcataaggttctccttttaatcctaaaaccacagcatcaatgttttctggatatcttaggcttataatttcatttattggataagattttttgaatattggatatattttgtatcctttaaagtaaatgccgtcatctctaaactcagctcctatattttttaaatagtaagcaaaagattttgtattttcatctaaataatccaataaagtgtttatattgtttgtttctattttgccatcttcaatttctattcttttagcaaaatttatttttacctcaccatttgttgatgtatcctcaatctttatcttcttctttcttatattataccaaactttcctaaaaaatgattttatcttatattttaataaaatatatcctccaaatattgccattagaattaaaaatattggtaaagcaactattgccaaaattatcaatagcaataaaattagaaatatcaaaaaaattcctgtaattccaccaactctataaaccttaactttcatctacatccctcagagcgtttttgattaaagtaatatattcatcttttttgggcactaccataatcttttttgaaggtagttttatagaagccctaaacccatgtttttttgctacttcagtggctattttgttatatttgtagagttcattaaagagtttctcatttaatagggcgttttcatcagcatactgcaaacagcatccttccctccaaaatccaattttatcacctacctcatgagccctctctatctctatattatagtaatccattagctttaaaacatcctcacaagctaatcttatcaaaggtctaaagaataaaacttctttatcttttcctttgctatatttttgtgggactggagtgagttccattttgttatatacaacctctccataaacatctctcagatagttcataaccgctccagagactttttcaagagcagaatctccagtcataattattctaattcctttttctttggatatatcaacggctttatccttcataatatttttacatattctgcagatactactacccttagcccccttagttctctttaaaagttcgtctgtaatattgtaaaatatcactgggatatcaaacttcttagagagcttttcaaccattttttttgatacatcccaactccatctatgatagaagtgtattaaatactctatatttaatcctaagtccttagctaaggcaattgctgttgagctatcttttccaccactcgccataactacaatgccttcatctaaggcatttttttctttaaattgttctatgatgtctctttttaattcttctaaattatttaactttcttttattttttgtccattctgagaattccatggtttcacaaagaagtgttttactttttatattgagtttttaactattaaaattgaatgttcataaaatatgaactttaattcaaaatagaaaactttatatacctttatgtatcttacaatctattgtaaattatggtgtcattcaaaaataacaaaatctactaatgaaaattttgaacgccttcttttagaaggcgttcatctataccttaaatcattaaaaaagttttgaatgacaccacacaacctacaaaaggtgatgctgtgaaaaaaatattggcattaatattggggctgtgtttaatagtcccagtaatttcaatagctggatgtgttggtggaggtaattctcaaccgtcaaataatgaaaaaccaagtaccataataattaggactacaggggcaacattcccaaaataccaaatccagaaatggattgaagattatcaaaaaacccatcctaatgtcaagattgagtatgagggaggaggttcaggatacgggcaagaggcatttgcaaaaggtttaactgatattggaagaactgaccctccagttaaagaaagcatgtggaagaaattcttatcaacaggagaccaaccattacaattcccagaaattgttggtgctgtggttgtaacctacaacatcccagaaattggagataaaactttaaaattgagtagggatgttttagctgatatattcttaggtaagattgaatactgggacgatgaaagaattaaaaaaataaacccagaaattgctgataaactcccacatgagaagattatcgttgttcatagaagtgacgcaagtggaacaaccgccatatttacaacatatctaagcttaattagtaaggaatgggctgaaaaagttggagctggaaaaactgttaattggccaactgataatataggcaggggagtcgctggaaaaggaaatccaggtgttgtagcaatagtgaaatcaacgccttatacagttgcatatactgagctttcatatgcaatagaacaaaaacttccagttgcagcattagaaaacaaaaatggtaaatttgttaaaccaacagatgaaacaataaaagcagcagtttcagcagttaaggcaagtattccaaacccaacagaaggatacaaagaggatttaaagcagatgttggatgcccctggagacaatgcctatccaatagttgcattcacacacttattagtttgggaaaacaaaaatggtaagcactactctccagaaaaagctaaagctataaaagatttcttaacatgggtattaacagaagggcagaaaccagagcatttagctccaggttatgtaggattaccagaagatgttgctaagattggattaaatgctgtaaatatgataaaagaataaatctaattttttaatattttttaaatccaaatttaaagataagaaattttatatttgggaataatatttttattaagcaatatacaatgttacaattatttaatcctgcgaaagtcttattaaaatagaacttataaaagccataagataaggattaaaaaaggttgaaaaccatggagattaaaaaactcctaagaaagatagatgaattcaaaataataacattaccagcaatatttgttgtgtttatattatttgttttaatattaggcttttatttcttcaatgcactcccagctattgagagatatggtattgatttatttataacaaatgtttggaaagcggctgaagaacctgcaaaagaagtttatggattagcagcgccaatttggggtagtatatatacagcaacaattgctgttttaatagctttgcctctatctatatgctatgcaatatttgtcaatgattatgctcctaaaagactgaaatatcctttaattgtaatttcagatattatggcaggacttccaacaataatttatggtatatggggagcattcatattagtccctctgttaagagaccatattatgaaatttttgtatgaacatttttcatttattccactctttgattaccctccattatcaggttattgctatctatcagcaggaattttgttgggaataatggttactccatttgcagcagctattattagagaggcttatgcaatgattccatctgtttataaagagggtttagttgctttaggagcaacaagatatgaaaccacaaaggttttaataaaatacataagaccagccataatttcagggcttatattggcttttggtagggctttaggagaaacagttgctgtttcactggttattggaaactccttcaacctaacttacaagctctttgctccaggatatacaatatcatcattgatagcaaatcaatttggaaatgcagtgttgtatgagtatatgacttctgtcctctactctgctggtttagtgctgtttgttataggattggttgttaatatcattggaatttattatttgaagaggtggagagagcatgtctcccattaaacataaaaccattagaatgattaaagataagatatttctatttattgttggggcattaactttattggcaatactccctttattccatataataatttcaattgttgaaaaaggactaccaataataatggaaaggggcttaactttcataactggaacgttgagtgagggaggaataggtccggcaatagttgggactttaatgctcacattcttagcgactttaattggcttacctttagctttcttagctggagcttatgcctatgaattcccaaacagctttattggaagagctacaaagatgttactgcagataatgttagaattcccaactatactggttggtacatttgtcatgggtatgttagttgttcctatgggaactttttcagcattagctggggctttggctttagctttaatattaactccttatgttgcagtttatacagaagaagcgatggcagaagtcccaaagatttataaagaaggaggttatgcgttaggatgcacaagggcacaagtaatattcaaagttattacgaagatggctaaaaaaggaattttaacaggaattttaattggtatggcaaaggttgctggagaaacagctcctctactatttactgcaggagggttgtatgaggtctatccaacaaatccattagagccagttggagcaattcctctcctcatctatacattagttcaaagtccttctatagaagaccaccagatggcatggggagcggctttagtaatgcttataatatttttagcaatatttgttccgataagatatgctttaaaggatgatataaaattataaaattttataaaatataaaaaagggatagaaatgacaaaggtgaagatggaaacaaaaaacctaaatttgtggtatggggaaaagcaggcgttatttgatataaatctcccaatctatgagaataaaataactgccttaatagggccaagtggatgtggtaaatcaacatttttaagatgcttaaataggctaaatgatttaattccaaatgttagaatagagggagaggttttattggatggaaaaaatatctatgataaggatgttgatgtttatgagttgagaaagagagtaggaatggtatttcaaaagccaaatccttttgctatgagcatctatgataatgttgcatttggcccaagaattcatggaattaaggataaaaaagaattggataagattgttgagtgggctttaaagaaagcggctttgtgggatgaggttaaagatgaactgcataaaaacgctttatctctctctggaggacaacagcagaggttatgtatagcgagagcgatagcagttaagccagaggttttattgatggatgaaccaacatctgccttagaccctatctccacattaaagatagaggagttaatggttgagttagctaaagattatacgattgttgttgttacccacaacatgcagcaggcaagtagggtttctgattacactgcctttttcttaatggggaaattaattgagtttggagagacagagcagatattcctaaatccacagaagaaggagacagatgactacattagtggtaggtttggttaagtatcatcatcaaaattttttaattaatcacaaaatatgaacttttatacttattgagggatatttatgccaaaaaaatttgatgacatagtaaatgagatggatagaaaaatagagctattaggggaagaaataataaaaaatctaaatcttagtgttgaaggatactgcacaaacaaaaaagacatctgtaatttggtaatttataaaaacaataacataatcaaaaatttagagtcattggagatgtattcagtaaaagctctatgcctatatagacccgtctcaaaagatttaagaaaattgctaacaattataaaattgtgttcaatgttggaaaaaattgaagaatgtgccgtaaagataagttttgttctgctaaattcaaaatttaattttgatagaaatgacaaatacataaaaagaatggcttctttaactgaggagataatttattgagtatttcttcttacataaatgaagatataaataaaattgatgagatatataaactacacagagaaattgaaaagatattttatgaagagtttcaaagatacttagcaagaaagatttttgaagatgtgtttatagtttttgcaaaagttattaaaattaaaaataaaaatttgaacgcccccacttgggggcgttcatatatatcctatatatttcaaaatgttttgcaaaaactataatgttgctattgtgaatgagctaaccaatataggaaaatatttagaaagatgcgaaaattctgcaaatgactttagaaaagagatatactttttaattactggcaaaaaaatgatatgaaatatatagtaaatttgaggagttgataaatatgaaattctttaatagggtggaagaaataaaagaaattttatcaattttagaagaagaaccaaatttaatttattttatttatggccccataaactctggaaaaacagccctaattaatgaaattatcaacaatagactggataaaaacaaatatgttgtgttttatatcgatttgagagagatttttatctctaagtatgatgagttcgaagcgaagcttcgagcaacgaaaaccttcggttttcgtctaattatagaagtcttgtttgaagagtatgaggatgataaaaagcctattgaaattataaggagtttgataaaggatgctccttctttatgtggtattccaacaccaaaaaatacattggaagaaattctaaaaaagaaaacaaccaagaatgtatttaagtatataactaacattttaatggatattaaaagagaaggaaaacagccaataattattatagatgaattgcaaaaaataggagatatgaaaattaacggattcttaatttatgagttgtttaattattttgtatcattaactaagcataagcatctatgtcatgttttttgtttaagttctgatagtttattcatagagagggtttataacgaggcaatgttaaaggagagggttgattacattttagttgatgactttgataaagagacagctttaaagtttatagattttctatcagaggaaattctaaataaaaaattatccgatgaggataaagagctaatttattcttatgttgggggaaagccaattctaattataaatgttataggtaaattaaaacataaaaatctaaaagatgttttaaatatcttgttaatggatgaaatctctaaattaaaggactttttaagtaatttggattatataaaaccaaaagttaatattgaggaggagattatcgaaattagaaaagaggacataattaatgcgttaaaattgtttaagggaaagtatgaaattgaagttgataaaataccaaaagcagtttatgtttatttagttaaaaaaaacattttatttttatatcctcaaagaggaactttaaagccacaatcatttttagtatggaatgccataaaaagagtgttataactatactttattttacttttatattgccaaaaaattatatggagggaaattatgccaaaaaagtttgaagaaatacttaaagaagttgaaaacgatttaatagagatggctgaactttgtgcagaacaaactgaaaatgcagtgaaggcatttattgaaagtgatagagagttggctaaacaagttagaaaaagagacactaccattgatttgatggagatgaaaatagaggaaaaatgtattaaggcaattgctttatatcaacctgtttcaggagatttaagggagttaatgactgctattaaaatatcttcaaaattggaaaaagttggagacaatgcatcaaagatttgcaaaattttgttaaagtcagatgttgagggtaatagaaagaatgaacttcttattgttatgaaagattatttaataaatatgttaaaaaatgcaatgattgcgtttaaaacaagagatgagagtttagcaagagatgtctataatatggataaaaggttagatgatttgtatgagcaactatatagaagtatgattagtaaaatcattgaaaaccctaaaaatctaactctttacactgaaataatattcgctggtaaatatttagaaagaagtggaaatattgttgcttcaataggagataggattgtttatatgattactggggagaggataaaagaggaagagatagaagaagaattaaaaaaagaaaaagatatagaaaagaatatagatcaaataaatgactaaataagtgaatagactctatttttattttttgcaaatagacaattttatatattaaatattcattttatttttattttgacaatttaacaaaggtggtcttatgaaaatctacttaaacggaaagtttgttgatgaaaaagatgcaaaggtttctgtgtttgaccacggtttattatatggagatggagtttttgaaggaattagggcttatgatggcgttgtttttatgttgaaggagcatatagacagattgtatgattcagcaaaatctctctgtatagatatcccactaacaaaagaagagatgattgatgttgttttagagacattgagagttaataatctgagagatgcatatataagattagttgttacaagaggagttggtgatttagggttagacccaagaaagtgtggaaagccaactattttctgtatagcaattcctatgcctcctttattaggggaggatggaatcagggctataaccgtttcagttagaagactgccagtagatgttttgaatccagcagttaaatccctcaactacttaaacagcgtcttagcaaagattcaggcaaactatgctggagttgatgaggcatttttattggatgataaaggttttgttgttgaaggaactggagataacatatttatagttaaaaatggagttttaaaaactcccccagtttatcagagtatcttaaaaggaatcacaagggatgttgtcataaaattagctaaggaagaaggaatagaggttgttgaagaacctttaactttacatgacttatacactgccgatgaactatttatcactggaacagctgctgaaatagtccctgtttttgagatagatggtagagtaataaataataaacaagttggagaaatcactaaaaaattaaaagagaagtttaaagatattagaaccaaatggggaataaaggtttatgatgaataaaaaataaaaaagttaaaaaattcaatttatttttttattttatccatttatttcctaattattgccattgctaaaactccctcaatatcaactgaatctacttcctctccttcgcagaataaagctcttttaacatctttaatgtgttcttttctaataactccatactctgtttctaaaccttcgttaatgattttttcaagtgtctcttcatcagcattcttaattaaatccataaccgcctttgcattctttttaaactctggccctatctttgatttatcaggaattatttcaacaatctttgattcaagggctggttttcctttgattattttaagctcttcaatcttcaatgtccctttaatatcctcggctgttttatttaaagctaaataagtctcttcatcctctgtataaatttcaacgtattttaatggagcatttaaagccattcctgaatttgccttaaatcttctaattgaaatgactgtatttttagctatttccccaaatttctctgcctcttcatttataaatctattatcaacttctggaaatgagaagtggagattatctatcttataaatctcagctatgtaatctgagaagtgtggtgcaaatgggcatagcaatctaacaaccttgtcaattacatagtataatgtccatcttgcttctttctttgcctcttcatcatctccatacaatcgatatttaaccatctctatgtagttatcacagaactcatgccaaacaaacttatagatttcaactattgtattaaacctataattctctaagtccttatcaaccctctcaattaatctctgcaatttactcaaaatccataaatcaattgggttgctaatttccattggtttttttagctcatcaataatgtcatcacttatatgcatcttagcaaatctacaagcattccaggactttcttaagaatctatagccgtaatcaacctctttccataagaattggacatcatctccaacaacactattacttgcccacaatcttaaggcatctgctccatacttagctataatttcatctggctctacaacatttcccctactcttactcatcttatgtccatcttctccaaacaccattccgtttataacaatctcatcccatggctttttaccagtcaaagctactgacttgacaattgtatagaaagcccatgttctaattatgtcatgcccctgtggtcttaattggacaggataatgcttctcaaagaatttatcatcatctaaccactttgttataaccattggtgttattgaagagtccatccatgtatctaaaacatctgtctctgggattaagtctttattgccgcacttatcacaaacataacctgttttagttgggtctattggtaaatcttcttctttagcaacaaccacatttccacactttggacaataccaaactgggattggtgtggcaaagattctctgcctacttataacccagtcccaatccatatcttcaatccaattcaacaatctaattttcatgtgctctggaatccacttaatttcatcagctacttctctaacctttgggatgagttttctaacattaacaaaccactgctcagtaacgataatttcaattggtgttttacatctccaacaaacaccaacattctgttttattggctcttgcttaactaaatagccctctttctttaaatcctcaataatcttctctcttgcttcctctgtttttagccctttatactttccagctatctctgttagctctcccttctcatcaattgctttcttaatctccaatttatgcctattaacccacaaaacgtctgtcttatccccaaatgtacaaaccataactgctccagtaccaaactccttctcaacatcctcatcagccaataacttaaccttatgcccaaacaatgggactataaactcttttccaattaaatgcttatatctttcatcctctggatgaactaagatagcaacacacgcagccataagttcaggtcttgttgttgctatcaacaaatgcccttctccatcagcagcagggaattttatataattcaatttgctttctctctctttatactcaacttcagcaaatgcaatagctgtttgacatcttggacaccaatttactgggaattttcctctgtaaattaatccatctttatacattctaacaaaggcagtttgggattttttaatatactctggagtcattgttatatactctttatcccaatcaatagaaattcctaaggattttatctgtcttctcattttttcaatgttttcttttgttaattcaatgcaaagctctctaaatttatgtctatcaacatctgactttgttatgccatggatttcttcaaccttaacctctgttggcagtccatgacagtcccaaccttgcgggaagagaacgttaaagcccttcatcctcttgtatcttgctattatatccatgtaagtccagtttaatgcatgtcctaagtgtaatctaccagttgggtatggtggtggtgtatctataatatatggtggcttattgctctcttcatcaaatttgtaaatcttactttcttcccactttttttgtatctgtttctcaatctctatattgtaatcctttggcatctccattatgaatcaccgtcaaatcttttgaagagtttttaatttaataaaaatagttgaggtttaaataaataactctctaatacatatttgtaaatttataaatctcattctataacttcttttatggcataccacttctttacagaggttggcttgattataccgttcatcacatcataaaacagtatctcatttttaattaaaaatttaacttcatccataagattatctcttataatctctttaatatcaacttttattttgttctcaaataattttaaggcatcaattaattttcccatctcaaactccttttgagtagaaattaaatataagattttgtccctctcaatattaatccactgctttatagtttgttcaacagataagccaagttttttattgtttattaattgagaaatttcataaggtagagataaatattttaagcagtaatcaacctcctcctcactaaaaccctcttcttttaagatatttctaatactttcttttcttaaccaatcaattaaataatattcagaggtattttctaaagtagagtttctatagatttcctctataaataaagtatcagaagttaaacaaataacatgacatagatgtcttactttagttaaatgcacaaataaattaaacaattcattcaacaaagatttatctcccttaccctctccattgaagtatatactctttaacttctgcaattcatctattattaaaattggtttctttccatctttaataactgcattaatactctctttcatcttgctaaagacatcatttaactttatattatcgaaatcaaatttctcttcaataccaaacttaaatatttttaagttaatttcaaatctatttagaagatactttttatctcctttttcaaaaaatatttccaaaaactcttcctttgttggtgtagcatattctctcaaatcataataaaaaaacaccaaatcatcttttttagataattcttcaataaccctaagcattaccgtagatttaccagaagatttaggaccataaacaaaaagtatagagttaggctctaattggacataattttttagataatttaattctttctctcgattataaaatttcataaaaatcaccaaaaaaagaatcctatttcttaaaccattctggatagccaactatcttatacccaccaaatggcccagacttactctctattttaaagccaagagtttttaaatcctttattctgttatgcactgctactctgctcttcctatcaatataatcttttaaaaattctccagatataaaatcagagtttttggcaaatattttatttctctctaaaatttttcttgcttcttcttccccaaacttctcagatagcttatgatataaatcattaacaccaataagaatatttaaaaggatgaaatgcccaatatctaactttatgttattttcataggccttttttaaaaactcccagaaatcataatctttcttttctattatgttttttatctcatcttctatcctcattcaaccccctttccttctttttgctaattttcttgccaaagcaaccatacctatctcaataagtccaacaaagaacttttctaaaccaccacaagcccaaatagcctttccaaaggttgtttttttaatcctctcctcatactcttgtggcgttatatcttctccagtcattctctttgttacaactgcagctgcttccatcaactcctcccagcttatatctccaatgtgattatgcaattccttaaatatcttatacactgggatttcatagagcttagctaatgttttgacaacatcacagttcctaaccattccaataactctaccatctcttgttaatacaggaatgctaacaaccttatacttaacgaattttaaaactacattccttgcctcatcatcttcatagacagttataacttcttcaacaggcctcataaactctgttataggctttttaaaatctttctctgaaattcctaataactccaatgtagttacccatccaactaatctatcctctttatcaacaattggggcagagaatctcttcttcttttttaatagatttatagcatcttcaacagtctcatctacatatatcttggcaaaattcttatccattaaatccctaactttcatagtatcacaaagaatatttatgataaaataatattatacttgcttaatgtttttatttctatctctttaggaattttaatacctattccattaatccaatttgttggttatatatcccttaactgcacttattgcggcaatctttggagatgccaagtaaatatagctatttatatgccccatccttcctttaaagtttctgtttgttgttgataaacaaatttctccctcagccaaaaccccttgatgagctcctaagcaaggtccgcatcccggagtgcaaatcatcgccccagctttaacaaagatatctataataccctcttttaacgcttgcaaaaataccttttttgatgccgggataacaattagcttaacatctttatgaacctccctaccttttaaatatttagctgcttctcttaaatcactcaaccttccatttgtgcaactcccaataaaaacttgatttatctcagtcccttcaacatcactaattggctttacgttatctgggtggtgtggaacagcaacttgttcttccatatctgttatgtcaatttctatctccttatagtagtttgcttcatctctatttactgttattctctctttttttaatttagctatatcctcatcagaaagtcctctctctttctttaaataatcataagtaatttcatcagcctctatcactcctgtttttcctcccatctctattgccatgttgcataaagttagccttccatccatgtccatgtttttaacaacctctccaccatactcaatagccatgtatgttgctcctcttctcccaatttccttacaaacccttaaaacaatatctttggcagaaacattttcattttttccaactatatctaccctaattgtttttggcactttaatccatgtttctcctgttgcatagatgtaagccatatcagtagctccaaagccagtagcaaaagctccaaaagctccatgtgtgcatgtatggctgtctccaccagctacaaacatgtttggcaaaacataattttcagctaagatttgatgacagatgccttctccacctttatggaaatttttaatgccaaatcttttaacaaactccaaagctaatttttgcatttcagcagctttaactgtgtttggtggaacattgtggtcaaaggcaacgactattttatctggattccaaacactatcactcatttcctttaaagctttgtatgctaaaggtgttgttccatcgtgtgtcattgccaaatcaacttcaacctctatgctatctcctgcacaaacttcataaccaactttttttgatagtatcttctctaccaatgtcaatttatcacctaaatactttatttacaaaacatcccaaagaaaggtgttcaaattttctatcaaataacctaataacttttttgcaaaaaatataaccaaacctaatcaaagaataatatatttgcccttgggtctgtctcaaaaactatcttcccatctttaaataccctaactattcctccactttgtgaaacagtcacagctatagcattcgtattttttgatatacttgcagcagctaaatgcctcgctcctaaaccttttggtatattaacatctccttttatctctaaaaatctccctgctgaaactactttaccttcatcagtaattataaatgctccatcaatagaagataactcctttatagtccccttaacattttcgtcaaatatgctcgcattgtgtccagcaaatggatttaatattaaaggttttgacatactcataacgtttaaggtatcccccataacaaaaattgttcctacatactctccttctcttccttctcttccaatttccatagctaattttataatctcttttaatgttcttttttgtttttcatccaatgtttcaaaaagttcataaagggttatagttttcacatgctcttttacattaaccaccattattgtatccaactttccaggagtttttggctctcctacaactgcaacaattttgttattttcttttaatattttcattttaagagcatgcactattccactacttattatcatgcatctgttatcctctctatgtttaataaagattggataaatattctcttcattctcagaagagatttttttataagttacttgatttggagttgcaacaattatttttacatttttatgagatattttgtcaagaatctttattattcctgaatgttcatctttttttaaaaaagattttagtaattcataagatttccccgtctcagtaaatatcataaacgcgtctgctttaatatcataagcaagttctaaaccatgctttattatgtatttagctatcatacctccaccactacaactttacataattcaattcggtataaccaaaacggatatattaaaaggagctttcatccccttaatgtctcttcaggactttgcatacctaactaaagcttcagctatcttcttatcagcatttattcctatatctctaaagcccttagttcccggggatgaatttaactcaataacataatagttgtcttttgttggtagtatatcaacccctaagattacagcctcagataaatcagcacattttaaggctaattcttcaagttcctcatcaatatttagtttctcaacaacatttcctaaataaaggtttgttctaaaatctctactaactcttctgtatccaccaacaacttctccatcaacaactaatattctcatatccctatataagtcattttctttgaaatcaataaactcctgtataagctttccttcccagatggcattttttgttaattgttttaactcatcataatttcttgccataaatacctttaaaccacactttgagaaagaattttttataaccactggaaatcttaaattgtatttctcaataaatttaactgcatcctcataatctctaattaaagctgtttttggtgtctttattttattctttgcaagtaactttatacatttaaacttgtctgatgtaaggtagagagttttaattggatttataaatctacagccctcaacttccaatgcatttatgaattgccaagagtagagggttaatctatcaaaataatctcctattccacatctcgaatgaattaagtcagtttctaatttaaaatcatggctcatcaaattttctgggcttgataataaaaatatatcgcatttagctcctaatttttcaatctcattctttaaactccatacactacagctccttccttctggtgatagtatggttatttttaccataaacatcccaaaaataaaaatttataaagatttaaattggggttagaaatttgtcaattcatctataccaattaatttctgctctccagttatcatatcttttacagttactttcccttcattaagctctttctctccaacaataattaccttcttaaatcctcttgagtttgcataatctaaagcttttcttagctttctccccataatctcaagttctacaatttttccagcttttcttaacttatcagctataattagagattttttaattaattccttatctttttttactgggattattaaaatgctctcttcctcaatatctaaatcatcgatattcatcataatcctatcaaatccataggcaaaaccaacagctggagttggttctcctccaaacgtttcaattaagttatcgtatctcccgccaccacatatctgcttagctcccttcttcccatagatttcaaataccattcctgtgtagtaatctaaacctctcgcaattccaaggtttattgtatatttatcatgaataacaaactctaaaatctcctccaaattatttatcgcctccatagattttgggaagtcctttaatatttcctttagttcatccaaaacctctctacttcctttaaacttcaatatctcaaatattagctctttcttctcctctcctaagatttgagttagataaatcttcaaattatcataatcctctttatcaattaatcttcttattttaacctcctcttcctcactaacattaaatttctctaaaactcccttcaaaactcccaaatgccctatatgaacatcaaaatccaaaccaatatttatcaatccatccattgctaaattcaaaacctcagcatctgccaatggttctttgcatcctattaactcacaacccatctgccaaaactctctaaacctccctgcctgaggtctctcatatctaaaacaattagcgaaataataaagccttaaaggtttttgtaggttcttcaattcatttaaatagaatctaacaaccggggatgtcatctctggtcttaaagccatttctctcccaccatggtccttaaacacatacaactgctttctaatctcttctcctgtttttttagctattaactcaaagctttcaaaggttggggttaatatctccttatacccatacctctcaaaaacctctcttagcttattttcaacaaatcttctttttttcatctcctctggtaaaaaatctctcgtccctcttggtttttggaacatcactatcatccttaaatacgttttgttttttgtaaataaatagcaaagctatcttataaatctttgtttcatcagcataattttgtaagatataagtatttatatatttacagttattgatgttgaatcaactttacacaaaaccgaaaggtttatatagaatttcattaacatatacataccgaataaggtaacaatctgaggtgagaagatggcaatggcaggagcaccaatagtagtattaccacaaaacgttaagagatacgttggaagagatgctcaaagaatgaacatcttagcaggtagaattatcgctgaaacagttagaacaacattaggtccaaaaggaatggacaaaatgttagttgatgagttaggagacattgttgttacaaacgatggagttacaatattaaaagaaatgagtgttgagcacccagctgctaagatgttaatagaagttgctaaaacccaagaaaaagaagttggagatggaacaacaacagcagttgttattgctggagagttgttaagaaaagctgaagagttgttagaccaaaacatccacccatcagtcatcatcaacggatacgaaatggcaagaaacaaagcagttgaagaattaaagtcaatagctaaagaagttaagccagaagacacagagatgttaaagaaaattgcaatgacatcaattactggtaaaggagcagagaaagcaagagaacagttagctgaaattgttgttgaggcagttagagctgttgttgatgaagaaactggaaaagttgataaggacttaattaaagttgagaagaaagaaggagctccaattgaagaaaccaagttaattagaggagttgttattgacaaagagagagtcaacccacaaatgccaaagaaagttgaaaacgctaagattgcattattaaactgcccaattgaagtcaaagaaacagagacagatgcagaaataagaattactgacccagctaagttaatggagttcattgagcaagaagagaagatgattaaagacatggttgagaagattgctgctacaggagcaaatgtagtattctgtcagaaaggaattgatgacttagctcagcactacttagctaagaagggaatcttagcagtaagaagagttaaaaaatcagacatggaaaaattagctaaagcaacaggagcaagaatcgttacaaagattgacgacttaacaccagaggacttaggagaagctggattagttgaagagagaaaagttgctggagatgcaatgatattcgtcgagcagtgcaagcatccaaaggctgtaacaatcttagcaagaggttcaacagagcacgttgttgaagaagttgcaagagcaattgatgatgcaattggagttgttaagtgtgcattagaagaaggtaagattgttgctggtgggggagcaactgaaatagaattagctaagagattaagaaaattcgctgagtcagttgctggaagagaacagttagcagttaaagcattcgctgatgctttagaagtcattccaagaacattagctgaaaactcaggattagacccaattgacatgctcgttaagttaagagctgctcacgagaaagaaggcggagaagtctatggattagatgtcttcgaaggagaagttgtcgatatgttagagaaaggagttgttgaaccattgaaagttaaaacacaagctattgactcagctacagaggcatcagtcatgctcttaagaatcgatgacgtcatagctgctgagaaagttaaaggagacgaaaaaggaggagaaggaggagacatgggaggggatgaattttaattcctcctctgaataaataaatttttaagcttttattttttatttccttacattaatgtatttttatatatagtggtgtctaaatgggaaaaatagatactgacacccctatagagattgttaaggagagtatatgattctactttgatatattgaagtccctatatgcccttattttcttgttatttgttattgtcgtttcatatatttttaatggattgtggtctgtatttaatataaagcacgtcttttgggttaatctttttttattgatagcttttcatccacaacatttagatggtttaattattcttctcttaattccattaaaaattttcagtaattttaaattaaaacttcaatgtattatagcactggttggaatactattaacaataattaaaggagtaataaaatcaggttttggatggattttgaggattctattcttttttgtcagaatgatgacagtttcctttattaatttagttgtgttttcgattttacttacaagtgtttatgtactgggttatgttgcatttttaaaaccagatgatattcaatttggaacgttatatactgcatttggaggtcttgcacttttaggagcaggaataaaaatcatacaacactttattaaacagtcggaggaaattgcacaagaagaatttaaaaagtggtatgaaactgaagttaagaattttatgtattcgttatttataactgcaaaaaatgcttttccaaaatttttagatgatttgttagctaagggagtggtttcacaggaggaatatcaaaatttaataaaattatattcccacattttagctagaattttgaaaaatgatgaagagaaaatgaaaattccaacgttttagaagtaaaacgaattaattatgtgaaatatgtaataattattgcatcattttttaaagaactattagatgaaatattctcagaaaatgaaccaaaacttatatctaaaaaagaaaataaagaattgaaaaaattatggtcagacttaatagatgatttaaaaatactcttgccctatacaacatatccaacaataacattggattctcttgcacgattaagccgtttgagtttaaaaagagatttaaagataatctctgaatacattaaaaatgagaattttaagaaacagtagctattgttctaacacatccaccaccatcaccaactggaacactctgcccatcctttccacagtaaccaacacttagctcaaagtcctttgtaactgcatcaactttaaataaaatatctaaaatctccccacttaaaccagcatcttttaaaacctgagttagttctccattttcgattaagtaggcttcaactgcactgaattggaagagccctttaccagtatctacctgtccccctctcgaaccctttaagaatattccttcttttgtgtcctctaaaagctcttcaaaactccaatctccaggttttatgaaggtgttactcatccttacaattggtttgtttaaaccttcagctctaccgttccctgttagctcagcatccattcttccagctgtttctcttgagtgtaaataagtttttaaaattccattttcaatgataactgtttttttaccttcaactccctcatcatcatacttataagaaccaaaagctccctcaattgtagcatcatctataactgtaacatattcacttcctactctttctcctaacttatctttaaatacactatcattctgcaaaactaagtccgcctctgatgcatgccccactgcctcatgtataaatactccagctaactcagggtctaaaattactttaaatttcccctttgggcatggttttgctttcaataatcttaaagctctattttttgcttctaaagctaaatttaaatagttatcttttattttctcaaatccaaaaccaccagttctctcagcaccatactgcagattcccattttccttagcaacacagttcatatacattatgcatcttgttatctctccctcaatccttgaaccttcgctaatcataaatattctctttccaaacacatcagaatagctaacagaaatacttttaatcttttcatccgtcatatttttgtatgtatcaataataatttctttcttttcttcaatatcaacatcagttgggtttattttcccaatcattttataattatcaattattgccttgtaatcttttaatataayctctttttctgaatattcatttgagattttagccattttatacgctttatttatgagtttttcgatttcctcttcactcactatgtttgatgtaacaaacccccatccatttttgtataagactctaacagctacaccatttccaaaacctgatgagatttcttctattttaccatcttttaatgttattgtattgctctctccaaaatttattcttatatccgcataatctccaacttctaacaatttctctattttttccaagttaagcatgttatcaccaaagacattaaaatactttttataaaatattttaactattattataagatgtatggtgattatatgaagtatatgaaaaagatagtgttgtttttgataataaatatactgcctatactcatcttaggtttatatttatatgcaaatataggaggagctgaggatgttaaggaggttatagaaaattcaccatttaaagaattcacttatatagaccataaaacccttatgatgctcaaaaatgatgttaatctcaaaaacatgccagaattctataaagagtcaataattttaattaatgggatttatattggaaatcatgggagttttggtataaaaataccacttggatttttaattaaatacattccaattgataattttaagtattataatggagttttgataaaaaatctaaatgaagatgatttaggaaaagctgagatgaatgatttagttaatacaatccctccgaactataaggatgttcttatatatagggagaactatacaattggcatatattatgacctaaattcaaataaaacatatttgatagaggtatttagaaaaccaaataatcaagaaattgatactgaaaaacttagaaatgaattgttgcaaaaaacaaatgcagttgattgtaatgtagttgatatgggggacaaagtttatgtttatttggagtttaatgggatagatttaaatttaataaataacgggataacatgaaagttgtgataacgagacctaaggaaagggctgatgtttttgccagtttattaaaaaaagaagggtttgaaccaataatatttccaacattggagattgtatataataaagatttagatgttaatttagacagctatgattggatagcttttacctcaccaagtggtgttattggactatacaatatactaactgaaaatgaaagagaaaatgtaaaaaataaaaaaattgcagttattggagaaaaaacagcaaaaacttttaaaaaatattttggtagggacccagatataatgcctaatgaatacactgcagagtccctcctaagagagattaaaaaagtttctaaagaggaggaaaaatttttaatcccaacaacaccatcaacaagagacgttttaaagaataacttaaatgctgatttgttatttgtgtataaatcagcagagccagaaaacttaaaagaggatattaaaaaactaaaagagttaatagcaaaagataaatttattctaacatttacaagtggattaacagctaagaatttttttaagtatgtggatgatgagtttgctgaaattataaaagataactacatagtcgccattggtcctataactgccaaagttattgaaaaatttggttttaaaccattaattcctaaagtatatacgattgaagggatgttagaagttattagaacattaaaggagaggtaggaaaatgattaatatcaatgatagagccttaataaaaaaagccatagataagataaacaaacttgctgagaagatagataaattaaagattatgcacgtctgtggaagtcatgagcacacaatctgtaagtatgggattagggatgttctgccagagaatataaccgttgttccagggccgggttgtccagtttgtgtaacaactcaaaaagagatagatacagccatatatttagctgacaatggatatgtaataaccactcttggagatatgtatagagtgccgggaagtgaaaaatctttgatggaaaagcaatctgagggttgtgatgttagaattgtctatagtataagtgaagcagtaaagatggctaagaaggagagagataagaagtttgtttttgtggcaataggttttgaaaccactgctccaactactggggctgaactaataagtttaaaaaataaagatgttaataacttctttatcctaaattgccacaggcagactcctccagttatggagttcttgttaaatgagggagtttatttagatgcatttatatgcccaggacatgtttcaacaatcaccggattaaagccttattatgggttgtgtgaaaaatacaaagctccaatggttgttgctggctttgagccaatagatgtgttaatggctataataatgattttaaagcaagtcatcagtggagaggcaaaggttgaaaatgaatatattagagcagttaagccagaaggtaatgttttagctcaaaaaataataaatgaagtttttgaaagcatagatgttccttggagaggtttcccagttgttaaaaatggtggttttggattgagggagaagtataagaaatttgacatctatgagcatgaggatattccagagattaaagagaaaattcctaaaggttgtatatgtgataagattttgagaggagagaaactgccaactgactgcccattgtttggaacggtttgcactccattaaatccagttggtagttgtatggtttcagatgagggaacgtgtaggatattttataagtataggaggatttaaaacaaattttttctatttttaggattttactcattaaagttagcttcatactcttttatatacatttttatacaaattcaaatttgtcatgatttatcattatagattaaaaccaatctgtcattatttttcattaaaaacatttatcatgattgttcatgagcaaaaaagcatatatatgacttttttcaatgatataagtgaataggactttcgcagtttatatattaagtttggaacttagacacccaaagggtgtctatatacaataaaactttatttcctgcgaaagtcctattaaaacaacaataggtagggtgagaatatggaagtgaagttacaacacatacatgtaaatgatggggaatttgaagaattagaaagcataaaaagagatttaacaaggccatatactggaagtgaattaacaaaaatcatgggatacatattagctgggttgattataatatctgcaattgcacctattttgttttaaactaacgaaatttacagaataaaaaaagagtagtttggactatttttatggataaaattgtcatgatttatcataataaacagaattaacgaattttttccgaacaatttatggtttataaaatttaacctcataagtaatctcttttgtttttactaaccaatctggttttgtatttttttctgtcataattatcttcgtctatacataatgttaatgacttcgttataagttggtaggttatctttatccttaaaatattcaagaacattttttaatccaacaattttggttttactttttggtttttgataagagaggttagttattgtttgctctataatttctatatctatctcagcttcaatgactttagtaaatgatatggaaacatcaacatcataatcacacatatttcttaatttccttaaatcttcaagagcttcagccaaagttattaaatcattcttcaaattatctactctaattttatcagataaagttctgaaatatgctggtaatgctttatgtgcctttccactatttaaaagttcataaatcccatcttctctatcttgctcaatctctttaacaatctctctaagttttaaaaagatacaatagtagtatctcccaatagcagttcggtattttccttcatttggtagagatttgaaagttggtagcttttcagctatttctttaaattcatcaatattaaacacttacaacacctccaagtcagaggtaacaattaaaaatccacgcatatctgggtatttctcatcaacttttctccaagcatcaaatataatctcctttagctttcttataataacttttatatcctttaactcccttttatccaatttcttcttaaaaactatctccacaactaccttatcatcaattccatcataatctaaaacaatctcaaattcctcatcagaatattttttctttaaataatcttcaacaaattcagctattttgtaaattttcatctttaaatcttcatctttaacaaatagtttaaaattctcagttttcttgtatttttcctccaattcaagctttttaatagcctcttcaatctttttctttgaaatattggaaggaacttttagagttatagttttagttggcataattatcaccaaattaaaaatctcctctcaaactaataaaacttaattgtttctaaatgtataaatagcttcctcttttaaaaattcagaagactattcttctaaacatttagggtagtaaaagacaaacgcaagaaactataaaattaaataaaaagcttataaaaatagccattaaaaactctaataaccaactaagcaattaaacttttttcagattaattttttatactttttaaacctacttttattaaaaatctcatggtgatagctatgaaaaaacttgatgttactggagacatctgcccagttccagttttaaagacaaaaaaggctttagaagaattgaatgaaggagaagagttagaggttgtaggggactacaaaccagcattagaaaacataaaaagatttgctgaaaataacggctatacagttgttttagctgaagaaacagagagtagatttagaatagtcatcaaaaaataggtgaaataatgaaattcaccgtaatcattacagaagctccttatggaaaggagagggcttactctgccttaagatttgcattaacagctttattagaagggattgaagtaaatatcttcttacttgagaatggtgtctatgttgctaaaaaggaacaaaacccttcagaagttccaaactacttagagctattaaagaatgccattgagttgggagcagttgttaaagtttgcggtccttgctgtaaggcaagaggtttaaaagaggaggatttaattgaaggagctaagttagctacaatgcacgacttaatcgcctttgttaaagagagtgataatgttgttacattctaattttgttttgcttttttatattcctcaacaaacctcttatagcagaggtttaatacctcttttataaccttctctttgctcttactcttatcataaggagcatttagtccaccagcctcactatgccctcctccacttcctccaagttcttttccaatcttctccatcaaattgcctaaatgcacatacttagaaacatgctttctacatcttgcactgactcttatttctttttctttcttcctaacagctacaacaaaggcaacatctgctcctatgcttacaatagtctttgcacaagatgcctcatgagaactaacatgagataatgctattctcaacttatcgaattccctaatttccattctactacatgcctttaaatgggctgttctcttactaacgtcactctcttgagataaaaggtagagaatcttctgaaagcttatgtcctttatcaaatagcttatcaactcaaacgtttttgaattagctaactttaaatgttttgtatcataaactattccacacaataaagcaattctaacattttttggtggaaagatatttagctctttaaaaatctctgctataatctcagatgttgatgggtaatcctccttaattatatagtatttacatatatcagctaaatctgtcttcttatgatggtctattaaaataacctctctctccttcagctcatcaaaattaacctttaactgattaattgatgcagtatcaactataaaaactgtttctgggagtttaggataaatctcaatatcaaccctctcccctatctcatttaaaatatttcttgagagtttgctgacagaatctgctgaaattctaaactttccatttggatttaattgagatgccaagtattttaaagctacacaacttccaactgcatcggggtctgcattgtgatgacataaaaaaagaacctcatccctctttaaatattccaataactccatttttgctcaccacaaataaaattaaaacaatcataatttaaagcttaaaacttctaaaaataataaagctaaaaaattaaaataacaaacaaaaataagataggattaatttattgtgctgtaggtatcattttttgaatcttttcttgaagttcttttaatcttgactgtaatttttcttcttgcttctctaatgtttttactctcaactctaatgtttcgactttctcttcgagttcttttttgacatcttccttttttcttttaacaaacaatccaccaactaatttataaacttcatcacttgaagatttttccaactcttctaatgcctttttacattcttttaattctgtctcaacactctgcttctgcattaaaatcatttgtagttgttgctgtaattgctgtaactgcatcaattgagcttgaatttgtggtggtaattccataacagtcacctcaagttaagctttatagttttttgcaaaacattttggaataataagacattataatgaacgccttcaataaaaggcgttcaattttcctttattaattttaatcacttttgcaaaaaactatatattgctgatagtaaaataactaccaataatataaaaatcttttcctccttagataagcagaatttttattcgtagtatctaaacttcattgttatgcaatttacagtcatttttgattttttagttaaaaattatagtgtcttagataataatcacacaaactttaaataatattgtgtttaatatgtgttttaggtgagtacattatgacacaaagagaaaaagataataatataaaaagagttcaagttacattcactaagagtcagtgggaattaattgaaaattttagaggaattttaggacaaactgatgctgaaattgtgagaaccattgttttaacatggctgtctgaaaaatcaattatatcaaccaccataaagaaagaaataggggataaatgatgagtattgatataacaactaatcacaaaataatctttggagatgcaagaaaaatggatgaaattgaggatgaaagtgtgcatttagttgttacatcacctccatatccaatgatagaaatgtgggatgaattattcaaaatgttaaatctagaaataaataagcgttggatggagatggaaaatgaagaagatgaagagaaaaaagaaaaattaatcatgcaaatatataatttaatgcatcaaacattatatccagtttgggaagaagtctatagagttttagttccaggaggaattgcatgcatcaacataggagacgctacaagaaaaataaacggagtttttagactatttccaaatcattctaagattatagaaaactttgaaaagattggattcgttactctcccatatatactatggaagaaaccctcaaacaagccaaatgcattcttaggttctggatttcttcctccaaatgcttatgtaaccttagatgttgagtatatattaatatttaggaaaggaaaaccaagaaagtttaaaccaaaagacccgttaagatatgcaagtgcatacactaaggaggagagagacagatggttctctcaaatttgggagattgttggagataagcaaacacatccaaaaatagagagaagaacggcatcatttccagaagagattccaagaagattaataaggatgttttctataattggagacaccgtcttagaccctttcttagggactggaacaacagtaaaagcggctattgaattaaaaagaaactctattggatatgaaattgataaatccctaaagccaataattgaagaaaaaattggaattaagcaaaaaagaataggaatggattttaatgtagaatttattaatcgtggttaatgataattacttcgtattttcaactaaatccaataaatcggagtaatcaacaataattttatttttcttcttttcataaataattaaatgccctttaagttcttcagacaagtgtttttcctgattgacataagttttagatttaattgatacaggaatttctttatcatcaataataattactccatcaatacctttagattcttcttctatagtagaagggcgataatttccaccaagttcctctgcaacttttttcaaaatagcatcctgcaacatcagcccttcataagtttttataagaactaaatcctcaacccactttcttacatcatctctttccaactgttctaaggtttctttaaaattattaagcatgttccaaattttttcagtagcttcatcaatcgcattaggatatttttgcaaataccacttcttccaatcttcaaatgttctacctccagtttttctgaattctttaattaactcactcatctgaccaacgacttttggacgtgtgccttgtgaaaatatatttgcaagattgataagttgagaggcatattttggcagttcaggttttgaaggtagctctaagatttctctttcttcttcaaacgtaatttctataattccctttttatcttccaattttttcataagtttcaccacaatctacttgtgattacaacttttcaaataaccgttaaattaatataatagttgtctatagttatttactctaaagctttgatattataaaaggggatgtggcggcaatgctgaacccatagaagagggataaaatgggaatctacaagtatataagagaagcatggaaaagaccaaaagagagttacgttagacagctattatgggaaagattacagcagtggagaagagaaccagcagttgtaagaattgagagaccaacaaggttagacagagcaagagcattaggatacaaaccaaaacaaggaataattgttgtcagagtaagagttagaagaggaggtttaagaaaaccaagaccaaagaactcaaagaagccagctacacttggggttaacaagataacaatgggtaaatcaattcaaagaattgctgaagagagagcagcaagaaaatatccaaacatggaagttttaaacagctactgggttggagaagatggaaaacacaagtggtatgaggttatattagttgacccataccacccagctattaaagctgatcctcaactcaactggttatgcactggaaaacacagaggaagagcattcagaggtttaacatcagctggtaagaagggtagaggtttaagaaacaaaggaataggagctgagaaggttagaccaagtataagagctcatggaagaagaggtaagtaaattgataaaatttatatactcccttatacttatttctatcctttaggggaaacaaccactaatttttaaatccccgacaatattcaaaaagataacaactatttttaaaggtggaaaatatgagtgagaaggaattgttagtaccattagacacatacttggcttcaggtatccatatagggactcagcaaaagacaaaagacatggagaaatttatttacagagtaagaagtgatggattgtatgttttagatgttagaaagactgatgagagattaagaatagctgctaaattcttagcaagatacgaaccagaggatatattagctgtttcaagaagaatctacacaatgggaccgttagaagagtttggaaaatacactggaattagaacagttgcaggaagatttgtccctggaacattaacaaaccctgcatacaaagggtttatggagccagaagttgtatttatcagtgacccaagagttgatagacaggcattgaaagaggcaacagaaattggagttccaatagttggtttatgtgatacagagcacttaacatcgttcatcgacttagttataccaacaaacaacaagggtaagaaagcagttgctttaatctactacttattaacaagagagtatctcaaaaacagaggagttataactgacgatacaaaattaccattcacttatgaagagtttttagaaaaggcagcaaatccaaaatacagaattataattcaaccaaaagacaagagaagaagaaggagaagaagaaaataaataaataaacaaaatacttagaggtttttggagatgactgaaaaaatatatcttaagtgtgagaattgtgggtttgaagagcaggaagtattaaagaaaaaaatttataacaaatctgcatattacttagttagatgtccaaactgtggatctgtaagggagattgttgataaggttaaattaagccaggcaaagttaattataagcagatacgatatttcagaatctaaggtaatcaatatccctgaagatgaaacttacaaagttggagacacaattgaaattgatggagagaaaattgagataacaaaaattgaaacacctgaatcagttaaatctgccttaggtgaagatattaaagttatttggggaaaatctttatccattcccaaaaaattaggaatatcaataaatgatagaagtaaaacttatggtatatacatctatgtcccaaatgattttgagtttgaagtagagaaagtttataggataaacgatggattctttaggttaaagaagataaaaactgaaaaaggaactgctaaaaaagcaaaagctaaggatataaaaagattgtatggggatgtaacaagacctgtaagaaactatgttgatttatctgagttctataagggtgaataattcctaaaaccacaactaaattttttaaggtgaaaagatggctactgcaagaactgcaaggtcaagaaggaaagtaagaaaagtgagagataaatggaaagagaaagtatggtatgaaatttatgctacaccagaatttggaggagtatttattggctacaccccagcaaatgacccaagcttagttttaggaagagttgctgagacaagcttaagagatttaacaggagacccaacaaaacacatgcacagagtttatttcaaaatctttggagttacaggaaataaggcaattgctcaatattatggacatgatacaacaagagaatttatgaagtcacaaatcagaagaagaagaagtagaattgacgctatccttgatgttaaaacccaagacggccataagataagaacaaaggcaatggtcttaacagcttacagagnaaacacaaaacaaaaatcagacattagaaagaagatggaagagattataaaggcaatggctaaagaaaagacantcccacagtatgttcaggcaatgttgtttggagaaatggctgagaagataaagaatgaatgtaagaagatattcccaattaaaaacgttatcatctacaaatcagaagttttatcattagctaagaaagaggaaaatgaaggatttgtaaaagaagctgaagaagaaactgctgaagctcaagaataaataatttttactattttttagttttttaatattgatattcgattttttaattttgttttcttgcttcctacgagcgtagcgagtaggttaaataaactcttcgagtttgtagccgcatctttagatgcgggattaaaaatccaaaggacttttaagattttaaaggttttaataatcatacagtaagaaatttggataaaaatagaaaattatatatgggagtttgagtataataagaaaaaagagtaagtgtttatcgttagtccattaaaataaggatggaaacattgggaggactgcaacaacttcatcacagttatgttcttttgtttgaactcttagtccattaaaacaaggataaaacctatttttttccatatactaccaaaaattttaacttataattctcaaagaagaataaatctttttttaaacattaatttattaattcaaatattccaatatttttaactaaactaaaaccgtaaagtatatatatatgagttttgtagtattagagaagttctactttacattacttagataaagcataaattaatacataaaaagagtatcatttaccatataatctaaatttaaaaaattaaagcgaggtgaaaaaatgttaccaaagaaaattgactatataaaaatagccctcattgttgtagggattattgctttgtttctcccatggctcacaatctctgcctctacgataaacataaagacagacgaaggaattcatttatctgtaaatctcgcaccatttagagtttcatcagatattaaatctgatacaaacaacatatttgtagaaatgatgatgccatatgtcaaacaatactttgacatggctgttaaagaaaaaatgtcaacatttatgatgatatttggtataattccaataatcctctacattgcctcaatattcgttgataaaaaagcggttgtagttggagctggaatagcaggaattacctgtgcttcaatatttgttgtgttattcacagtagggctgaactcatcagattctggattagctcttacaggaggtaaagaagtcactccaatagatttaataacgggagtggtcaatgaaaaatccagttatctctctaaggatattataaagattcaggtggggacaggttggtatctaacaatgataattggcttggcgttaattgcatatcctttcattaggaaggtttaatttttaaatttcctctatttttacttactcttcaactcttataacactcccaaaacccttggaaacctttcttccaattcctaaataattaggaatgttaaaattaaccaaaaactctccccagaagccaataaacttatttcctttatatttaacaacaaagtcttcatattctaaaagccctgcttttaacttttcttcaactgtataatctaaatacttgctcatagataaaatatttccaactaaaattttctctaacaactctttctttccatcttcatctaactccttatactccaaataatttttctcattcaaagcaatccatggagatataaacttatacttaatcatattctcagcaactccaaattcttcaaacttcacctttgcatagccattaacaaccctataaacttctccttttaaatttaactctctaatatttaaaataatctctcccaaaatgtttatcccctcttttatgccaattaaaacagcatctccaccaataatcttatactgtatttttggatatgtatagagaaaaccattccgctgtggttgtgtaattctacataatcctcttttccaaatttgtttaaaatatagcccctcaaaaatggtgtttgcgattttttaagtggtttatctgtctttaaacggcatattaaaattggaatttgcataatatccccataaaatatttttatctcaaagcaatctcaaggtattttataaattctcttttattatctggaatatatgccccacaggcaaatttatgccctcccccactaccattaaccttttctgatgcatattttattgccttggctaaattcacatcctcagcaaagcacaatagcttaggacatcgtgcggataccttatagccgttttcatcctctgttattgcaaatatcggcttcatccaatccacttcttcaatagaataactcattccagcaacaatcccaacaatatttgacataattttatctgtctcaaagtattggaatctatctttttgaattatctcaacgtcatttttcacatgctctaatgcctcccttaagttatttctatgctttcttaagtttgagagcatttttctatagtatttatccctatctcccattaacacatttaaagctgtttcataatctccatatcttgaacatgcgtttatgcacgttgagaactcctctaaatctctcaatggagatccaaactcttctcctctaaattcataaacctctccaaatataacctttggaatgtaaggtgtccagtggtttgggacatagtttagacattttattaaaagctcatttccaataatccttttatgttcaaaaggaatttcagctaatctcatagttgggtttatttcaatatcatactttttatttatgctttggatgtatttgattatctttgaatcgttatttaataaatcagttctcacatctgcccaatatctcatagacacaaataaaggtcttgtttgcctaccatacatctgtaaatctgtttttactttaacatctccattcataattgcatcgcatagtatttttctattcaaaccaattaattttccctcaatgttttgaatatcaccaacagcacccaaaacagcatatttagccaaatcaatccaatcattgtttatagcttttgcaaataaatatgaaactccagctccgcaaatttcagctccgctttttgcaatggttagggggtttatatggatgatggtttttggaatctttatctcctctggttggtggtggtctaagataataattttgtctctcttatcagataagttgagttcatctaacttctctttaatcatctttaactgcccactacctaagtcagcaaagattattaaatcatagtctttaaatggaatgtcatttattgtctctatagtaatttgcttcaaaaacatgaaatcagcatccaagtttaatctctcagccaatttttgtaaaatagctcttgatgttagcccatcagtatctatatgggtaactatcaaaattttgttgtttttgttgttttgcaataccttagctccttttttcaattctacccaattttccatagtttcactgtgtttatttctttaaattatttaagaactatctgattgagttaattcattaattttattgtttataatatactttgcttcatttagttcatttattgcttcaaaaatgttatttccggaaatcttcctacatgcttcagtaattttactttttgcttcttctaaattgttattttgagttccattttctgaagtccctccgagtaattttataacattttcaatgagtttttttatttttctaagttttttctttaattcttctttttttgtatcatctaatctaatgtttttcaatatttttatgatatcatcgatatcattaacagttctctctaaactcaacattattattgtattttcaatatgtttttttgcattataatagacatctattattacaaatataagtataacaatcattgctacaataaaactttctgggatataagaacatattaggtttattatatcataaatgaaataattcatcaatggtggtataaatgatataaataatacaacaccaatcactttgcgatattcgtttgagtctattcttctatatatccaatctaataaatctaaaaaatagataatcacaactattataaaaaatcctgtcccaaataaaataattgttttacaactattagcaagatatccaagagcaatcactgaaatcatgtaaattccaataaatattgaaataaatattcttccagtagtgtcaataactttattaaaattatcaaatttagaatatcttttgggaattatttttatatgctcttcttttaaaatatacctttctaaattaacagttaatatcatattcctaaagaaccattttcctctttcaattataacaattattccaataagtgaaagtaaaatatttaccaaagccagaaaagcaataataatttcagtaggaaagttctgaaggttattactcaaatatctacacaatattccaacagcaccgtttatccctactaaaaactgtaaataaaacaacatatatgtccaaaaagagttctctgccctttcaatatggcttctgaatgtctcatacatttttagttttaagtcattttttggatttgaatcttcactcataaatcccccacctatattttcaagttcataacctaactaaataatcaaataataaaattccaaacttataaataattttaatagcatgaaattttaaatggtgattgttatggaaattgtcgttgatgctatctatgagaaaggagttttaaaacttaaaaaatctataaatcttccagagggttgtgaagttgagataaagataatcccaaaaaagatttcagaaaaaacctttggaatcttaaaactttcagataaagaaattaaagaaattcttgaggagattgaaaatggaggagaataaaatattttttgattctaatatattaatatatcacttatgtggtaaagttgaagctaaaaaactaattgaaaaagtagagaataaagaaatctgtggatttataaatcctatagtaatatcagaagttttgttcttttatataagggctacaacaaataaaaggcattatgacattaaaaaacatccagagattttaaaatcgttagatttagatatagtttttgagcttttttcaattttccaaatattagatttaaatagtgagattgttaaaatttcaagagaaattattaaaaaatattgtttattaccaaatgacgcattaatctgctcaacatgtaagttttataaaatcaataaaatatgtagctttgacgatgattttaaaagagtagatttcttagaaattattgaaatttaaagtgataaaatggacgataaatttgcctctaagtttgagatagatgttttaaacaaactgctcaataaaaacttctcctatgatttagcaattattttaaagaagattggtggcttagattacagaaaaaaagtttttattaatggagagtgtataggcatcttagaatttgatttaattgatttggattggaagtttcatccttatgcctcttattatttaatagaagaaccaaaaattaaaataaaaccaacaaagagaaagctaaaaggcaaaaaagtgccagttgatttaattgaaaatgctgaagagctaaaagatatcaatgagaatgattatgttggtgttgaagtaggaaattatgttggcgtagcagttaaaaaaggagatacaataaaaattaaggacttaactttaaagaaagagcttagatttgaaaagattgaagattatctaagaaaaaacaaagataggattgaaaaattagagaaaaaatccctatcaatcataaaaaaatactatgaaatgtgtaaaaataagaattatgctataaatacctcttttagtggtgggaaggattcttctgtctctactttattagctaacaaagttatagatgatttagaagtcatctttatagataccggcttagaatttaaagatactatagactttgtaaaaaaatttgctaaaaagtatgatttaaacttagttgttttaaaaggcaaaaacttttgggaatatctggaaaaagaaggtattcctacaaaagattatagatggtgtaatagtgtttgcaaattagagccgttaaaagagtatttaaagaaatataaaagagtttatacaattgatggctcaaggagatatgaaagctttacaagagaaaaattaacttatgaaagaaaaagtggctttattgaaaatcagataaacatcttcccaatattggattggagaggaactgatgtctggagctggatatatctaaatgatgttatctataatgaactctatgataaaggatttgaaagaattggttgttatatgtgtccagctgctttaaatgctgaatttttgagagttaaagaactttatccagagttgtttaataaatgggttgatgttttaaaaagatttggttatgatgaggatgagattttaagaggattttggagatggaaagaattaccaccaaaaatgaaagaattaaagaaaatattagaaaataaagaaaaaaagtaatttattgaacgctaatgctattatatagcccaactattccagtaaatattatttgcactgagatagctactaatagcaatcccataattcttacaaaggcgttaatgccataaatattaactcttctaattataaagtcagttaatgataaaatgattccagaaactaacatagctgataatatagagagaacaacaacccctttctctaagatactctgggttttgctaatcaaaatcatggttgttgttatagctccagggccagagattaaaggaatagccaatgggacataaactatactatcaatatcttcaaggtctaatctttcatctggtttgtgctttgtttttggaatttctgcgtgaagcatgtcccaagctattttaaagagcaaaattcccccagctactctaaacgcatctattgtaatcccaaaatagccaaaaatataattcccaaataaagcaaataacaataaaactaccgttgatgagattatagcctttttgataattctaattctctgttcttttggatagggataggttagagaatgcactattggaattaagccaattgggtctattgtaataaaaagagaaacaaatccatagatgtagaagttaagaatatccatatatttcaccacattgaatataaaatgctccccagaataacccaccaaactaatagtgttattgatcctaaagttttttcatttataaataattccagtatttgacctactttagaaatgaatctattttttctctcttttaataattctgggaaagcattccatacgtgaaaaccatccaaaggcatagctgggagtaggttaaataaagctaataaaaagttaaaccagtaagtccaatagatagtgtttataaataatgccgtgttttttgttggagaaaccataattccaagttttccttcattagaactaacaattttatacgtcagtattttattatccctcaaaatttttatctcatactctttttttggttctatagttttggcaaattctttaaagtcctctaatgaatttatttttttgccgttaatttcgtaaataatatctcctttttgtaaaaactctgatgctggttctttaacatcaataatttttaattctgttggtagtgtatagctaaatgaaagtaatggaattgatgttaaaaatattattaaatttgctaatggacctgctgaggctatagctcctctaatctttttatcagctgttttaaattcatctcctaattcaacaaaagcccccaatggtaatcctaataataataaaattcctgaactcttaactttaattccaaaagatttggcaaatataccatgtgctaattcatgcacagaaattgctattaatagagctataatccctggaatccatggaataacatctccaaataaaaatactactggctttgctgcttcttttggcagagttccagacaacagccttatactcatatctatgatattaagaagcataaaaaatccaagtattacacatattggtattgatataattcctattttttgccaaattttatattttcctaatttttcaattgtttttaatcccaatttagtccttaaaattccaaaaattcctccataagtctttaaatttattgaatctctgatactatataaaattatccagataattatagctacaattaatataactttagatgtatccatgttcaatcctccaaatatttttaatattttttattttcaattacctataactttaaatctaataaaaacgaagagtatatataatagttggtatgaatcttacaacataaaataataatggtgagttcatggaagcgttggttttagtaggacatgggagtagattaccctacagcaaagagcttctggtaaagttagctgagaaagttaaagagagaaatttattcccaatagttgaaattggtttgatggagtttagtgagccaacaatacctcaagcagttaaaaaagctatagaacaaggggctaaaagaatcattgttgttcctgttttcttagctcatggaattcatacaacaagagatattccaaggttattggggttgattgaagataaccatgaacatcatcatgaacacagccatcaccatcatcaccaccatcatcatgaacatgaaaaattagagattccagaagacgttgaaattatatatagagaacctattggagcagatgatagaattgttgatataattatcgatagagcatttggaagataagtagaaacatgtcaatttacacctccgagcgtaagcgaggaggtgttaagtggtatcccaataggaggtatcctcctatgggtagagataattatcgatagagcatttggaagataagtacttaataaagaatctactaactcctccaataaagataaattttaaataaatatcctttcttttttatttcttaacaatttacataaaaagtttataatattgctattttagtagttttaagtaattaaggaggttgaggtatgtttgctccagggcacataacaggattttttgtaatttgtaaatcttccaataagttaaaaactggttctataggggcaggaattactatagatagaggagttaatgtagaattaaaagaaggaaatggtagtattttttataataataagaaagtaaatatctgtgccgttgaaaaagttattgaacattataaaaaatttggatataatgatgattatgacataatattttcatctgactttcccttaggtagtggattaggaatgtctggaggatgtgctttaatattagctaaaaaactaaatgaaatgttgaatttaaatgaaaattatgcagagatagcccatataagcgaagtagaatgtggaactggattgggagatgttattgctcaatatgttaaaggttttgtcataagaaaaactcctggatttcctataaatgttgaaaaaatcgttgttgatgatgattactacattataattgaaatttttggtaaaaaagagacaaaagagataataactaatgatatttggattaaaaaaataaatgaatatggagagagatgcttaaatgagcttttaaaaaatcctactttggaaaattttgtcaatctttcttatgaatttgcagtaaatactggactaataaatgagaaaatcttatccatctgtgaagacttaaaatttacagttggagcttcacaatccatgttaggaaatactttattctgcatttcaaaaaaagaaacattagaagatgcattatctattttaaaaaatccaatagtttgtaatatttattactgaacactttataatattactatttttatgaatttctacctaactgtgaatcacgtccacgtttaacctcttaaaagctgattttaatcaatattggaagctaaggagacagaaagaaacttagttttcatcccgaattagtctgattttaattacatatctttattaaatgcaaatccatcccagtccttatttccattccgaatcggtctgatttaattaactgagacatttaaatggaaacactacattttagacagatttccattccgaaatggctaattttaatctataaataatgtcttatattaagaacactccttaatttgcattctacctttaatttctccattaataacttttttacatatatcaactatttcctttatgttgtaaatctttatatcagctgtttcgagagctctcctcgaaacattcccattttgcaatgttaccactgctaaatcactttcaatcattgctgggacatcgttagctccatcccctaccattattgtaaagtacccctctttttttagatttcttattaaatctctctttaactcctgatgagcctctgccattatatatcgttcatcaaccccagtaatttcagctaatctctttataaacccttttctatctccagaagcaatgaaaaccttaactcctaaatcttttagttgtttaattgtttctttaacctctttaaataaacatccagctgttgctattgtgtattcaacctctccagcataagtgtctattattaaagcacttccatacccagtttctacttcatatctctttaaaatgtttaatggctcttgtaattctttaaccttggtttttctatctttgaaaattccttctctatttatcggtgggttacaataagatataccaatttcaacctcttttaataagtcagatattaatttttctggattttctttatccactacctttaaagggtcttctttaattataactaatgctctacccttttttttatccactatatcaaccgtctggctattacaaataaacttatttttctttaaatctttaataactctcattatctttacaagagtcccagcactgtcaaacactatagccactttcataattaccccattaattaaatatatacgttcagatataaagaattattgtgggagcatgaagaggttggcagtgatattaataaccttagctttagtttcttcaatgtgcataactaattctaatgaaaagagggaaaatatgaaaaatgcaaaagttttaatggttatagctccaaaggactttagagatgaagaactttttgagccaatggcagtatttgagtcaaatggtttaaaggttgatgttgtatcaactacaaaaggagaatgtgtggggatgttaggtaataaaataactgttgaaaaaaccatatatgatgtaaatcctgatgattatgtggctatagttatagtggggggaattggttcaaaagagtatttatggaataacacaaaattgatagaattagttaaagaattttacaataaaaataaggttgtctcagcaatctgcttatctccagtagttttagcaagagcaggaatcttaaaaggcaagaaagcaactgtatatccagctccagaggctatagaagagttaaaaaaggcaggagctatttatgaagatagaggagttgtagttgatggtaatgtaattactgcaaaatctcctgactatgcaagattatttggattggaagttttaaaagcaatagaaaaaaataatgaataatttgcaactatttttattgttttttctaaaatttagatgattcttattttttaaagttttaacttaaaaaagtgatagtttctaatctcataatcttatggaaatatacaaatttgaaatttttagagaataatatttttccaaacacctttatcttcaaaccttcctaagtatttatccaacaatctatctttctttaaagcactaattaagcttgttggattttttgagtaatctaaatatttgctaagattttcatccccccttgccaatatacactggcaaatcatggagttgaagttctcatattctaccctaataccttctttttttaatgccttctcaatatacttaatttttttcttagatgataaatcaaactcttctacctcaaaatctgtatgtggctttggaatcattggattgactgagatttctacttttctaatttctttctttactttcttcgttaaatttataagttcttcaatatcttcatcagtctctgtcggaatgccaaccataaaatagagcttaaccttttcaactccaaattttttagctaaatcaatggcattagctatgtccctctctctaatgtccttttttataaactctcttaacctttcacttccagcttctggagctatggttaaagttttaggctttaaaattctcatcaaatcatcgtttaatgtatctgcccttaaagatgaaggagatatatgaactcccatatcatccaaaaagttgcataactcaactatatacttgtaatctccaactgatggggctattaaagcaactttattgactttattaaccttaactccttcttctgctaaatacattaaatcatcaagctttctaaaccttggtggataatagatagctctcgctaagcaaaatctacatcttcttggacatcctctaccaatctctaataagaaggattttccataagctccctcttcagaggttggctgatatattggataatcatctatagttaatttttttggatagattcttttaactttatccttctctaaatattttgaataaacaccctcaacatcaaactctctatttataacttttagcattacatcactgccctcaatctctccaacgataaatacatcaaaaaactcagctattgggaaaaaattttccattacacaaggccctccagcaacaaaaatagcatttgggttattttttctcaaatctttaattatctttattgcattaaagtaatcgttttcatactgtagagtaataaaaattgcatcaaaattttttattctatcataattctctaagaaatacactcctacatttaaatctctatatttgcttaaatgattagctagaacatgcacagctaagcaagaaatcccagctttaaatttgtttgggtagattatagcaacattctttatcattttaatcacaaaaattaatttattgactatctaacacattaacaacctcaccaacaactataactcctggaggtcttgcattttcttttttagccttttcaacaatatctcccaaagtcccttttataactctctgattctttgtagttccctccataatgattgctactggtgtttctttacttctttttgggttttgcaacaactctttaaccaaattttccaaattagttattcccattaaaattacaatagtatcagcatttaacttgcttaaatctacctgtttctctttcttatcctctgcctcatgccctgtaactactgtaaaggaggtagctacctttctatgagtaactggaatcccagcaacctctgggactgctatagctgacgttattcccggaattacctcataaggtatgttatgcttctttaactctaaaatctcttctccacctctaccaaaaacaaatgggtctccaccttttaatctaacaactaactttccttcctttgccttctcaaccaatattttattaatctcttcttgtttaaatgaatgttttccctttcttttaccaacataaattagctcggcatcttttttagcataatttaatagctcttttgatattaaatcatcataaacaacaacatctgcctctttaatagcttttaaaccttttattgttatcaactctgggtctcccggtcctgctcctactaagataactttgcctgtcattatttcaccagaaatgtttatattttttggcattaaaataagttatagcttctaatactaatttttatgggatggttatgggatacagagtaggaattgatataggtgggacatttacagacctcgtttattttgatgaatatagcaaagaatttcatgtagttaaagttccaacaactccaaagagtcctgatgttggggcaataaatgcaatagaaactgctaaaatagaatttgataagataaatattttaatccacgcaaccaccttaggaacaaacatgtttttagggcaagagcacttaaacccaccaaaaattgcactaattacaacaaagggatttaaggatgttattgaaattggtaggcagaggaggcctaaactttatgatttattctttgaaaagccaaagccattaataaagaggagagacagatatgaggttgaagagaggatagatgcaaatggaaatataatcactccactaaatgaggaggaattgcaaaaaatagctgaaattattaagaaaaaggattatgaagttgttgttatctcttttttacacagctataagaatccaatccatgaaaagaaggcaagggaaataataaaaaatctctgctctaatgtggatgttataacctcctacgaaataaatccagagtataaggagtatgagagaacaagcacaaccgttattaacgcctatctaaagccattagtgtccaattatctaaaaaacttcatagattctttaaaaaacaaaggctttaatggaaagttttatgttatgcagagtagtggaggcatctcaaatataaaatatgccactgaaagacctgcagcatttatagaatccggtccagccgctggagctattgcagtcgcctatttttcaaaaattttaaatgataacaaagttataggctttgatatgggtggaacaactgctaaggcatcaactataattaacaactctccattggtaacaaatgagtatgaggttggaggagaggttcatgctggaagattaattaaaggctctggttatcctgttagatttccatttattgatttggctgaggttagtgctggaggagggacaatagcatgggttgatgaaggaaatgccttaagagttgggccgataagtgctggagctgacccggggcctgtttgctatggaaagggaaatgataaaccaacaataactgatgccaacttaatccttggtagattgggagagaagcttagtggtggtctattaaaattaagaaaagatttagctgaaaaggcaatatcaaaattagctgaaaaaataggggagagtgttgaagaaatcgcctatggaataataagattggcaaacaccaccatggcaaaggctttaagaatagttacagttgagagaggctatgacccaagggattttgtcatgtatgtttttggtggagctggacctttacatggagttgagttggcagaggagatggagattagctctatattaattcctccttcgtgtggtgttttctctgctttagggcttttattggctgattgtagggtagataaagctaagagtatattgaaagatatagatgaagttgatgaggaagagattgagaatatatttattgagctaatagaggagggacttaaagaggttgagggctttgaggagataaagatagttaaacagattgatgttagatataaagggcaatcttatgaactaacaatcccttggactggagatttaaaagaattggcagataacttccacaaaaagcatgagactgtttataaattcagttctttagaggaagatattgagttggttaatgcaagggttacaattattggtttattaacaaagccagagataaaatgttatgaagttaaagaatacaaaccaaagccagagagttatagaaaggtttatttcagcagtggatgggaagagactgcaatttataatagggataagcttaaaccaggagctatatttgaaggaccggcagtagttgaagagtatgattcaactatcgtaattcctccagattatacagcttttgttgataaatacggatgtttaagaattgagagataaaaggggattgttatggataaaattacagttgaggttattaaaagctctacctcatatattgcagaagagatgggaattattttgagaaatacagcctattctccaaatattaaggacagattagattttagctgtgctatcttatcatcaaatggagagttaatagcccaagctgaacacatcccagtgcatttagggagtatggctattggagttaagaataccgttgattatctaaaaaaagagagcattgagattgagaaggacgatgtaattatcgttaacgacccatacatagctggaactcatctaaatgacatcaccctcttaaaaccaatattttataacgatgaaataattggctatgtggcaaataaggctcatcatgtagatgttggtggctatgcaccaggaagtataagcagtaacgtaaaagaactctaccacgaaggtttaattattcctccctctaagctcgttataaatggaaagttaaacaaagagctcttaaatctaataacatcaaatgttagagtgccaaaatcaacaattggagatttaaaagctcaaatagcatcattgaacattggtgttgagagaattttaaaactaattgaaaagtatggggatagagaagttactgaggcatggaataagagtttagattattctgaggaatatttaaaatcaaaaattagagatattaactgtatatgtgaggcagtagattaccttgaatataaggacaaattaataaatataaatatgaagattgagataaaaaatggcaaaataaaagttgattttactggaacgcatagacagttagatgctccattaaatgctgtttatggtgttaccgttgcatcaacatcctttgcattaaaggcagttatagaccctgatttaccaatgaatcatggtatctttagagttttaaatatcattgctccagaggaaacaattgttaatccaaagaaaccagctccagtttctgttggtaatgtagaaacctctcaaagaatagttgatgtgatatttaaagccctctaccatgaattcccagatagagtgccagccgcatcaaacgggagtatgaacaacgttattattgggggaagaggttgggcattctatgaaacaattggaggaggatttggaggaagaaatggaaaagatggagttgatggagttcatgcaaatatgacaaacactctcaatactccaattgaagttatagagaacgaatatccaataatgattcttgaatactctctaagagaagattctggaggagctgggaagtataggggaggtttgggaataaggagagtttataaaatgctatctgactgcatgctctccataattgctgatagaattaaaatttccccatggggagttaataatggctatagtggagcgtgtggagagcattatgttataaaagatggtaaaaaaatcccattatctggaaaagatactttatatttaagttgtggtgatatagttgaaataaacactcctggtggtgggggctacggctctccttatgaaagagatataaatctaatattagaggatgttaaagatgaaaaaatttccataaaatcggcatatagggattataaagtaaaaattatcaaaaaagatgatgatttcgttgttgatatggaagaaacaaaaaagttaagaggtttgtgagtttgattttgcttttaatctttcctctaattttttccttctcttttctttcttctctctaatcattgggattctatatattgctccgcattctaagcatgttataacaacgtggggatatctcttgctcttaattctaacccttgcattccttccatacaacaaaaaggttccacattttttgcatatccttctcttccattttttagggaatcttattctcattttcatggctattcttcttgctaaatatacatatctcttagctctatcccaattacctttctttgcctcttcttcagctaagctcatcaatatatcaattctttcataagctatcttctttagctttttttctaagaactttttcataataaaccccagaatccatatcttggattgtatatatctccagctttctttaaatattctaaggcatcattaacatccttttcagataaaccaatagccatcgctttttcatatatctcctcttctggtgctaaaccatcatctctcaagctaacaatctccctaataatgttaaggacagcgtccatcttatctcttcttgactttggagttccagctatcttatccaagtccaaagttccagtttctgggtcataagctacctgttttaagcaatcatcaataatacttattgccacttcagcatcgacatcttcaactttatctgatagtcttgcctttgcatgcatttcagcaatcctaataattgcctctaactgccttgcagttattggtattgggttatccccctctcccaactttctcatctctaagtaatactttttaatcatcttttttgctttatcagttaaataaggcataattaactttgtttcatcaaactctcctaagtataaatcttgattctcttctatgtatgcacagctccttgcataaataatatagtattttaaaagcttctcatccactgttattccatcaatatcaatagctcctaagattttgtagtcttttgttgctgtctcaatatgggtgtttaatatatgttcagctatctcttcatcactctttctatttggtttatccatcaatggaaatattaaatcaaatctactaagcaatggggctggaatatctatctgctcaataacagttaaattcctatcaaatcttcccctctttgggttgcatgctgctaaaactgcacatcttgcgggcagtttaacattaatccctcctttattgacgtggattgtctggctctccatagcctccaatatatatttcattacattcttatctacagttagctcatcaatacatgcagttccttcattagctctaacaaaaacccccggcttaacaacccatccatctccgatttcagtagcctctcttgttactatagcagttaaacctcctccagtagcagttgttactgatgcataagcattttgagggaataatcttgctattcttctgagcattgttgattttccaatacctgggtctgtaattaataaaatatggctatcccttcttaaaggagtcccatcaggtaaaaatttaaaagctccttttatttgttgcaaaaatatggcttttttaactaattcataaccttttatttgagagattagatagtttgataaaatgtcaataatatttttctttctccctaattcatttaaagtctctataagctcttcatttcttaatatatctttaacttcaattttattataactttcagaaattttaatatagttacttttaatgtaaattttataaattgggatgttatgtctatactctcttttcataacccttcctataacatttacccttcctgcatatattcccggagtgttttctaaaaagactctaatgctcctcgctggctcttcaggatttttcattaaatcaattggctgctgaatctccatctcctgaatattcacatatattgaatcatattcatccaaaatgaactttatttcctttaaattttctttaaaaacttcatcattttccttcaaatccacacatcttgggattttccctttttccactaatttatcccaaacttttttgttttctaaaatttttttgacctctcttggagataacatgtccttaataaattctccttcactaaagtagtcatcaatctcaatttcaacacgtccatcacatggagtatatgtgtatttacacaaaaaacctccattttcatcttttattcttttgttacagtaatatactgccttttttaaaagtgcattaacttttcctgcttgcagtatatttccttcaaatttaaccaatttgtttatatcttcagcagaaatctcctcaattaatttttcacaaccttttggatttttaaatgcaatttgtatcttttctaactctttatcttcaccaaatagttcaacataagcttctttaaatatatccaatattatttcctcaatttctttcggtctctcaatgattaagtcattaacttcacatgcatctggaaagtgcattaaaaacttctcaatgtcaaattcaaagatattccccttaattaaattattagacagctcttcttttataaaactctttattttatgttcataatatgctctaaaaacttcttcatcaaaatttaccatagtatcacgtaaattgtctttattataaatttaaaaatagattttccatttgagagttgaagtgtagttaaaacataataaacaaaatagtggtatataatttactactataaaaacctttgtatattcaaattaataataagagataactttttaaccccctacgatatataatttcctaaaagcctatcataaaattttataagagggatagggatgaaattcttcttagacactgcaaatgttgaagagattaaaaaatatgctgagcttggattagtagatggggttacaacaaacccaacattggtagctaaggaaggaagagatttctatgaagttgttaaagaaatctgtgaaattgttgaaggtccagtaagtgctgaggttatctcaacagatgctgagggaatggttaaagaggcaagagaattggcaaaattagcagataacatagttataaaaatcccaatgacaaaagatggaatgaaggcagttaaaatattatcagctgaaggaataaaaacaaatgtaacattagttttctctccattacaggctttagttgctgctaaggcaggggctacctatgtatcaccattcgttggaaggttagatgacattggacacgttgggatgaagttaattgaggatgttgtaaagatatacaaaaactacgatattaagactgaagttatagttgcttcagttagacacccatggcatgttttagaggcggcaaaaataggagcagatattgcaacaatgccaccagcagttatggacaagctattcaatcacccattaacagacattggtttggagagattcttaaaagattgggatgaatacttaaagagtagaaaataaagaataatcccaattcataaaaataatttttatggagggagattatgaaaatagatgcagttaaaaagctattgatgattccagggcctacaatggttccaccagaggttttaaatgcaatggcattgccagttattggacataggacaaaggattacagcaacttattggaagacacaatagaaaaattaaaaaaagtattcataactgaaaacgatacattcttaattactggttcaggaacagcagcaatggatatggcaatatcaaacataataaaaagaggagataaggttttaaacattgttacaggaaactttggagagagatttgcaaatatagttaaagcatacaaaggagaggcaattagattagatgtagaatggggagatatggcagagccagaggcagttaaagagatattggacaaatatgatgacatcaaagcagttacagtagtgcataatgaaacatcaacaggggcaagaaacccaataaaagagattggagaggttgttaaggactatgatgctttatacattgttgatactgtctcatcattaggaggagattatgtaaatgttgataaattccacatagatatctgtgttactggttctcaaaaatgtttggcagctccaccaggattggctgcaataacagtcagtgaaaaggcatgggaagttattaagaagaatgatgacaaagttggtttctacttagatttattggcttataaaaaatactatgaagagaaaaaacaaaccccatacacaccatcagttaatttaacctatgccttaaatgttgcattagatttagttttagaggaaggaatcgagaatagggttaaaagacatgagagattagcaaaagcaacaagggctggtttggaggcaatgggaatagagttgtttgccaaggagagggcaaggtcagtaacagttacatcagcaaaatatccagaaggcattgaagatagcaaatttagaggtatattaagcaacaaatacaacatagttgttgctggtgggcagaagcacttagctggaaagatattcagaattggacacatgggaatctgtggagagaaagaagttttagcaacacttgcttgtgtagaattggctttaaaagagcttggatttgaagttaaagagagtggagtagaggtagcaaaagaagttctattgaaagaatagattttatttatatttaaatttaattattttttccataatatagccatccacaacaaaccagctataattaaaactattatataccagttatgtattacccaataaatttttggttctaattcttttttaatatcatcccataagctatgtttctttttatacaattttataatgttttttagttttatctcttctattgagttgttttttacaatataatagtgtagtttgtgattttcgttggtttcaatcaataatattccgttattgtatgctaaatccgtaattcttatactttcatatttatttccaaaaatcttttttagatagcttttttctattggaatttctcctcctttgattttaacaaaataatatggatttgagcaattacttatgatttttatggttttatttttccatataagaagatatggcttctgatttaaataatcttcataccaacctgcataattgatattggagcaattaagtttcttcataacaatatataaagtcccatttatgctgtaaaaatccatacactcccaagaaatattttcatattttggaagagttatgttatcttcgaaatggatttttccaccgtaataagaatacaaaggaaatgaagtatttgataaacgcccatctaagatataaaacttctttgccttcgaatcataggttgtaaagatgaatataggttgatatatgtaatgttggaacgtagtataatagtcgtcatcctcaaacttctttaattcggttatgttggtgttatttattaacacaagaatattttctggataatctgctttcattttataacaataaacaagtaatgcctcattaggggaacatgctggaggagatatatcaaaatcatcaactgaataaaaaacatcagcccacagtattttctcagtgtagtttattttattgttttttgttgtgtatactaaaacacctaaaaaaactattccgtcaccattttttgggaaataaaaatatccaaaagataatatagttaaattattagttgagccacactcaaaatatgttatattatgatacaactcagggaaataatagtcagaaataggagttatgtccattaaatttttattattaaaatacaaaatctccgaatcgttgtaagtatatccaaaaagcttatcataaccaatatcatggtaaattattataaatccatccttaaatggacaaacttctgctgaagagacatttaaaaaataaatagaaaataataaaattattaaaaataaaatgaattttttcataatctcaccagtttttacatccttttataccgtaagctccatttctcaccttatctacattctcaatatttgtgtcaaagtagtatgctcttatttgccaaatatctctaccagttaagaactctcgggctttaatataatcacatgctttgtttatcaaatcatgatatttatattcatcaattttattatctacttccatttctatatatccattaggaatttcttttatccaattaagaacctctataagttttgttattccctgagttaaatatccattatatctgttaatttggtatttccaatattctcttatatcttcactcacatttttttcatagttccagagacaccagtatttccatgcaatataatagtgtggttgaacaaatacatagtcaaaatactttgataatcgttttatatcattattatctggattctctatatcgttaatatagggaatccatataaactctaattttctgttcaattcattagatttttgtttgatatatgttgataattgtgctatttcccaatcagtaataaatccccaacttacttgcccaggagattcaaaattccaataaaatcctactaaattgctatcacaactttcaataactccatcaatccaacccttccagtattctaatgttctttttaccagataaatatggtttatataatattccatctgttttttgtctttggaagcattttttaatttttctaacattccacgtttataataaggaatttgagcaatatacttaattccagagagttctgaatttataaactctccaaattcttttccatctttttcaccatcttctcttaaatttccactttccggagttccactaccttcatccttttccaaagcaattgcgtagttaaaccctctatttaataaatcacctactgttccattaaatcttttctcataagtattggtgtatttaaaataccataaagcgtatttatactcaggttttggttttggcttgggtttgggttttggaggtatataaatatcgtcccccattatttcacccctaaatactctttacacttattaaccaatttatcaaacatctcaacatctctactctttatataatcggcatacggctcatctaactctcttatatacttattatagtaaattttaaccgaattaatcatcctaccaatatcttgctccttcatagcatcataaaattcatttaaagcatgttctttcctttcattatcggttaaaatctttttcttatagaaaatctctgattttatcaaactttttccaagtttatacaatatagggcagaatacacatgcatgatagcaacttgaaattagatttttatctaagctttcaaattctttaacaagcctttctcttgagacatttaagtgaataaaaggaggaaataagttataatcgttacaccacgttaaaaatcgttctttatctttaatatgctctcctattgatgatgctacaactcctccctcaaaatttttaataccctcccaaactacacaacttccgtgataatcatgtccattattttctaagcttatcttgcattttccacactcaataaatctatgtttaacatcatttgctttcataatccactttatctcttctcttacccattttggacttctatctgaaataaacgttactgcctcaaagtcaaagttatatttccccctaagctttaataaatatcctaacaaaaccctgtttttcattccatgagagtatagaatagttttatgatttgtttctttaattaaactccaaacatcctcatgcataaaaacccactatataaaaaaatctatattattttttaagtaaattttaattatcaaaagacttacatataaaagtttttattattctttaatttaaatggataaattaataaaaataaaataataaaacaaaaattaaaaagatttagcttataatctcctccaaaatctttaaaaacctttcaacctcttcaaacgtccctattgatactctaacataattatcccctaaaccatcaaaggatgtgcaatctctaacaataacacctctttttaatagttcctcacaaaattcttttgctttcattgtttttaattcaaccaatagataattagcttctgaaggataaactttaatatccttaaacttcttcaatccattgtagagcatctctctacttttaattccatctctaacacatctttcaaagaattctctatctcttaatgcagttatggcacaaacttgacttaaccttgttaagctaaatattggcttaactctcatcatataatctatgatttttttatttgcaacaccataaccaaccctcattcctgctaaaccaaagacctttgaaaaggttcttaaaacaataacattatcatattcaggggctttttgagtccaatcatattcttttttagcatactcaatgtatgcatggtcaataacaactaaagcgtctgtttcattgataaccctctctacatctctattttctattatatttcctgttggattatttggagtgcagaggaaaataaccttcgttttatctgttatattatttaagacactttcaacattcaatttaaagtctttctccttatcatatttagcatattttattttagcattgtggattgttgctgaaactctatattgggtaaatgttggaattggaattataacctcatctccatcatcaacaaacgttctaaatattgtgtctataatctcatcagctccatctcctccaacaattatgttttcctcatcaacattcaaaaatttgcttaactctttcattaaaattggatttactggctctggatattggtgaattttgtcaatttcatctaaaattttttcttttatttttggagatggtccccaaggattttcattagaaccaagttttataatgtcctctggttttattccgtaagcccttgctatctcttcttttgattttcctggaacatagggctttaattttttaacaacgtctcttactttattttctatcatccaatcacccaaaatttttaaccaaaaatattttaaataagatttctggattttttattattgttaagattacaaatgatggaggggttaattgtgaagaggacacttttacttatactcttattggttataagtgttagctatgctctacctatagagccaataatctatgtaaataaatccacggtagattatcaaaatgcaaaaattttgatggacaatttttactcatcaagagagataaatatcaatggagataatgtaacaattgttattaacgatattatgtatattccatctatagatgaacttgaaattaaaaatggagataaaaatcttattataaaatttgatagagacggaaacaaagtgaaatataaagatattgagtgtattgaatatttaaaccttaaaaagggagaagaaataagcttattcaataaaagctacatagttgaagatattacttcaaattatgtaatattaaaagaaaaagatggaaaggaagtattgacaaatgaatcatttgaatacgatggatataaagttgttgtaaagttggtttcctctgatttaaatactataattgttgatatatacaaaaatgagaaagttttggattctcctaaattaactaagggaaagatttattatatgaaaggaggaaccttagggttaatgtatgaaaattgcacaaggattggcaaaggttatagatttacttttagagtatattctacaataaaaattgaagaaggggaagattacccattagataaagagtttaaagttaaagaaataagcactgataaaataaaacttgagtataaaaatatagatagtttaggaaatgaaatatacttgtttaattacaccataatacctgaaaagtgttacaaagattatgttctctttaaagttataaaaaggaaagaaaaaaccgtagatgttaaagatgttgcatatataggggatggaatttatgctgtaaaggtaaataataccgttcatgtattctataaaggaaaagaactcaaaaatcatgaaaagatttatcttggttcggtagatgtatatagttctaatcctttaaatgttaataaggacataattctaattggaggtccaaaagttaataaaatcgttaaagaacttgaagataaaggtttattgaaagtaaatatctctaccaattatccgggaaacaatagaggaatcatactaaaaataaaaaacccatataatgataacaacatctatatattagccggttctgatagatggggaacaaaagcggcgatattagtatttttaacaaaatataatgatgaagatacattgatggtagagtgggacaaaggagagataaaaattattaaataaaaatcaatttaatcaaaaattttcttaatatatggctcaaatggaacaatatcttccctacttcttggacttataactgctacttttaatttcctctcttctggaattaaatcaataactaaagttcctggcgtggcggttatagaccatgacagcaaaactaagccagtaggattattaataattgattctatctctataacttgagggtgtatttccccatttatgcttcttttaactacatcaacccaagattcgcatattgctttaattaaaacagccaaataaccaataactcctaataatctcataaacctccccccttataaaaaccatgcttacaataagttttattaaggcattaaaatatatatctcttactataggactttcgcaggaataaatgttttattgcatattgacacttttgagtgtctaaattccagtaagaagataagctgcgaaagtcctatctacataatgcttatggggtggaaaatatggctgaagatttaagacagaaagcaatggccttagaaatatacaaccaacaattacaaatgattcaaagtgaaattacttcaataagagcgttaaaatctgaaataatgaattcaattaaaacaattgaaaatataaaggcagatgaagagacattaatcccagtaggtcctggagtgtttttaaaggcaaaaattgttgatgataaggcattaattggagtaaagtcagatatttatgttgaaaaatcatttaatgaagttattgaggatttaaaaaagtcagttgaagatttagataaagctgaaaaagaaggcatgaagaaagctgaggaattagctaaagcaataactgcattaagaaaagaattacaaacagagatacaaaaagctcaacaagctcaagataagaaacaataaaaatgtaaaattaaaatttttatccttttttatcttattttttgtactcagaatgcttgattaaactaaaacagtaattcctatatttaaactaacaaatgtttatgtctaaaataaaaatagtgggcccagccggattcgaaccggcgaccttcgccttgtaagggcgacgtcatagccagctagaccatgggccctcaacctttagcatcaataaaaatttaactcatcatatataaagtttatgctcattggtgaaattatggatttaaatttaaaaaattttttggaagatagagaggaaataattagagatgctaaaaggaaagatgaaaaatccttcaaagattttaagaaaatagttgaagaaataaaagaaagagaaaataaagataaaatcgtctgcgattttactgaatacaacccattgcataaagggcataaatatgcattagaaaaaggaaaagagcatggaatttttatcagtgtattgcccggccctttagaaaggagtggaaggggaattccttattttttaaacagatacataagggcagagatggcaataagagctggggctgatattgtcgttgaaggcccacctatgggaattatgggctctgggcagtatatgagatgcctaataaagatgttttatagcttaggagctgagataatcccaaggggctatattccagaaaaaaccatggaaaaggttatagattgcataaataagggctatcatattcaagttaagccctataaaattatctgtatagagacaggggagattttaggagagaagttaaatatagacaactatgtcattgcttcaatgtctcagatgatttataaactgaatagagagggcttaaaatttaacccgaaatttgtttttgtaaagaggttagagggaattagtggaactaagattagagaagcaatattcagtggaaagtttgaagatattaaaaatatgcttccaaaaacaacattaagtattttaaaagaactctatgataatggaaagctcaatgaattgatattgaaaagatttgaagatagaattttagaaacagcgaatgagtatgatttatatgaatatttgccaagtaatgttgctgaaattttagagaagaaaagaccatttaacaatatagaggagataaaaaactctctaccttatggattttcaaggcattttagggagaggattttatctaaattagaggcaaggattccaaatgaaactttatcaaaatatataaataactatcctgcaaagataaaaatacttgcagtgaaactttaagaaagtttcatcaaaacgatgcattaaatggactttcagtcccttaatgtctcttagtatataaataggtaaataacgatatatagttgcttataaatcttaatgctttgaatatgaaatcctataattttcatttaatagaaagcgaaactttttagatataaatttcaatagaaactaaattttggggagaggtatgcaaaaacagagattctgcttagacacaagtgcttttactgaaccgtcagttaggaaagcgttaggggttaaaacagttactgaactaacagataaggttatggatttgatagctgaggcaaggataaagttaaatatatcttgtcacattccatatccaactgtatataatgaattgatgggatttttggagaatgagaattgtccgagagatgttatagttaaagttgatacatggcttgttaaaaaaaccccaaacagatatgagataaaaatcccttcagagattttttatgaatatgttaaagatttgagagaaagaattaacaaagggatgaggattggagaggagcatataataaaagccacagacatggtttatgagttatcaaaaaaacatccagaaatgggtaaaaatgaaatcataaataaagtgttatcaaaaacaataaatacctttagaaataaatatagaagtgctttgagagtgggaactttagatagtgcccctgatttagatgtgttattgttagccaaggagttagatgctgcggtagtggcaagtgatggaggcattgaaaaatgggctcagaggctgggcttgagatttgttgatgcttctgattttccatttatgcttgaggaatatttgaaacataatgatagacatttgaggataaaatactaagaaaatttaaaattaatattaaaaaacacgtttagggatagttatgacgatattgctaatcagaggagatagttatgaaaaattaaagaatgccttagctgatgttgataggcatgcagagctaacaattattggaaagccaaaaattattgttccagaagctgcagatgaaatattaagtcatatattgggggaagttaaaaaaccatgtaaaactgcatgcttagcaaagattgctgaaaaagcaccaaaagcaatagatagaattagaaaaattcatccacctgctcatattgttgtgattagtgagagatatggtgacatatattataagttattggacgacttcccaaaacttccagtgttaaagggctattacaaatctaagaaaaaagataagaagaaaaagaagtaaattggttaattttcattagtattaggtgatttttatgaaaaatagcacagaatatccaacattagtggaaataaaagacaaaaaaggagaaatgattgagaagggggaggcaaaacttagagatttaaataacataagagtaaaattaaacgaattaaggacgagcaatccagatgatttagatactattgctcaattggaagaggaagaaagtcatctaacatctgaagttttaaaattagatttaagcataaaaatattagaagtggttgaatatattatagaaagtaacatatttgaagattattggaaaataatagaagagaaaattccatatgaggagttattaaatattgtggttgaaaatggcttaagtataaaaaagacgtgcatggagttatataaacttgccaatattgatgataaaaatattttaaagaaaattcagaatctaccagatgactatcctaaggaaacaaaagaagacccaaaccttcaaaataaatatttgagtaagataatttcaagaattagtcgattaaaagaatttaaaagcaatttggatgagatagtttcagatataatctcaaacatgaggtgagtggatgaaaaaagtagagcctgttaattttagagagttggataagaagataaaaaagttctgggaagagaatgacatatatcaaaaagtaaagaaaaagaatgaaagaaataaggaattttattttgttgatggtcctccatactgttctggagctatacacttagggactgcatggaataagataattaaagacacttatctaagatttaagagaatgcaaggttataatgttttggataaagctggatgggacatgcatggattgccaatagaagttaaagttgaaaatgaatttggaataaagaacaagaaagagatagaaacaaaaattggagtaaagcaatttatagaaaagtgtaaagaattcgctttaaaacataaggaaattatggaaaagcaatttaaaaacttaggagtttggttagattgggaaaacgcctatatgccaataactaaggaatatatggaaattggatggtggacattaaaggttgctcatgagaagggattattaacaagagatttaagggttgtctattggtgtccaagatgtgaaactgccttagcggagcatgaggttagaggagagtataaggaagtttatgacccatccgtttatgtaaaattcagattagcaaatgaagaaaacacatacattgttatttggacaacaacaccatggactttagttgctaacttggctgttactgtccatccagattatgactatgcatatgtagaagttgaatttgatgacaaaaaagaggtttggattattgctgaaaagttagttgaggaagttataaacaaagctaaaaaattccataacatcaaaaactacaaaataatcaaaaaagttaaaggaaaagaattggaaggtataaaatatattcatccattattagaagagaatgagagacagaaagaatttgcagaattagaaaatgctcatacagttattttaggagagcatgtaaccttagagggaggaactgggttggttcatactgccccaggacacggggaagaggactttgaagttggtaaaaaatacaatttgccaatctattcaccaatagacgatgaaggtaaatatgtagaaggaaaatggaagggcgtttttgttaaagatgcggatgctgaaataattgaaaccctaaaaaacaaaggattgttagtttatgctggaaagataaaacacagctatccacactgttggagatgtaaaactcctctattatttagagctacagagcagtggttcttagagatatcaaagattaaagataacattatagagcatgctaaaacagttcagtggataccacactgggttgaaacaagatatataaatggagttaagttcgttggagactggaatataagtaggcagagatactggggaatccctattccagtatgggtgtgtgagaagtgtggaaaatacattgttgtaggaagtgttgaagaattagaagagaagatgataaataaagatgaagttggagagattaatgatttacacaaaccaacagttgataaaataaagctgagatgtgaatgtggaggagaaatgaaaagagttccagatgtcttagatgtttggtttgactctggtttagctccttatgcttcaattggagtaaaagagcttaaaaaagcagactttataacagagggacatgaccaagttactaaatggttttattcacagcatgcactctcagcaatagtatttaacgatattccatacaaaaagtgtttaatgcatggcttcactttagatgagcatggagacaagatgagtaagagtttgggtaatgtagttaatccagatgatgtcgttgaaaagtatggggctgatttattaaggttttatttattgagtgcaaataaggtttgggaagatttaaggtttgtatggagtgagatggatgatgttttaagcttattcaacactttatggaacgcctatatgtttgctgtaaattacatggtgttagataactttaaaccagatgaaaaatactttgaatatttaaaagatgaggatagatggattgtaagcagaataaacagtgttgctaagatagcaattgaaaatcttgaagtcccatacttccacacatacacttggacattaaaggatttcatattaaatgacttaagtagatggtatattaggttgattagagacagaacatggaaagagaaggatgacgctgataaattagcagcatatcaaacactctactatgtcttattaaagttagctacaatattggctccagtagctccacatactgctgaggcaatatatcaaaacctaaaaacagaagatatggaagaaagtatcttcatgaataaaatagaggttgatgaagagtttattgatgaggagttagagagagatatggcaatagttagagatgtcgttgatgcaatctacagaggaagggataggataaaatacaccttaagatacccattgaaagaaataactattgctggtggagaagaggttaaaaaagctgtagagagatttgaatacataataaaagagcaaggtaatgttaaaaatatcaaatttggagaggttgaaggtagcaagtatataataaagccaaactacagagagttaggtaagagatatagaagtgaggttccaaaggttgttgaggcattaaataaagcagatgctaaggagttgatggagaggttgaaagaaggagctgtaatattagatggatatgagattaagccagaatatgttgaaattagattggaaattcctgaacatatagcaggagttgaattctcaaagggaactgtctttataaataccgagattactgatgatttgataaaagaggggctaatgagagaggttataagaagaatccaagctatgaggaaggatatggatttagatattgaggagaagattaaaattaaagttgagggcattgacttagatgaatttaaggagattattgagagggaagttagaggtcagtttgttgatgagataaaggcagattacgaaaaagattgggagataaaaacaccaaatggagagaaatacaacgttaaaattgctattgagagaataaataaataaaaatttctttttagttttctttaatacttttacttttatttctatttttaattgtttttaatttataaaactaagacaatattattctgtgtgataatatgattctaaaagagggggaagtagtttttgaagttccagataaattgacagttacaaaaaaggatgaggtattttataatccaagaatgaaaacatgcagggatataagtatagcagtaattcaggcatttctaaatttgtatcataagagagataagttttacattgctgatgctttggctggaagtggaattagggggcttagatacgctaaagagcttgagtttaatggagagttaaaggtttttttaaatgatataaatccaaaagcttatgagaagataataaacaatgccaaattaaatgagattgagaatatagatgtttttaatgaagatgccaacacatttttatctaagcattttagattttttaatgttgttgatatagacccgtttggctctccagctccttatgtagagcaagcaattagggctttagtaacaagaaatggtttgctctgtttaacagcaacagatacagcggcattatgtggtaggtctaaaaaatcatgcttaaggaaatacttggcttatccattatttggtagggattgtcatgaatttgcattgagggttttagttggatatgttatgagaatggctacaaaatatgagcttgctttaaagccagtattttgccatgccacagaccattatgttagagtttatttagttacggataggggagctaagagggctgataaggtttttgaaatgcttggctatgttaaggatgtaaatggaattaaaataattaaaaaatttgaagaaggttatgagaaaggatttgctgggcctttatatataggcaatttgtatgataaagctcttgttgaagaggctttaaaaatagctgaaaagagggagtttagtgaaagagttttaaagattttaaatgccattaaaggagaatctgctataaatcaagttggatgttatgacactcaccaaattgggaaaatgttaaagatttcagttccaccaatgcaagatattataaacaagctaaaagagatgggatttaatgcagttgtaactcactataatccgaaaggaataaaaactgatgcaacattaaagaatgttattgaggcaatatatcaatgtaccaagattaggtgaaattatgaatcttaaagaacttactgtaattttgattatcccaattgtatatttgggagtgtgtggttgttttgaaattgtcccaaaatccttttatgataatttttcttcgtataatgtgggggataaagcaccgtttggagaatggaaagttaaagaagggggatttaagattgaggccatattaagcgaagataaaaaaacactaaacaaagttgcagtaccaataaacaatggaataatatatattgataaaaactatactgactttaagtttattgttgatataaagcgattagaagaatcagatagcccaaagatatacttcagattgataaataatgcaaatgctggatattatattgatatagaaggatttgatagggggtatgttctctacaaatttaatggaactaaggttgaaaaattggctgaatcttacgatgccgctcctgctggcacagatttttataggtatgaagttgtagcaaaagataataagataatcttccttgcaggagggcagaaatatattgaatacactgacaataatacaccaatacttaaaggtggaataggaattggagggggtagagcatactatgacaacgttagagttgagccaatagaataaaaattatattaagattttcaatcatttattatgaatattaacaatttttgcgttgatgatattatgattttttccattaataatttgaatgatgatattttgattattttttgaattttcaataattttttctacttcatataataatagtgccttttttcctaatggtgttaatttatagtatgtttttggtaatgcctgtttgttgtcttctttcctttttgatattaatcccaattttaccaattcatttaatgttctgtttaaactgctcatatgagtaggaatttctttatgaatttgactaaaatggagttctcctttttcattaagtagttccaaaatttctttaacatattttttgcttagtatcccaataagcatgatttagcccttttatgattttttatttttgcttttttgagaattttcatatttatacgataattaacatttttgctaaatttcacaaaaaagagaaaagtttatatttgtgtatagttatatctatgttagtaaatatgctaaatttaacaaaaatgttaaaagtggaatttaattaggtgataacaatggacacgataagaaaagctttagtttgttttagcatactctctattttggttttagcttgtgggtgtgtgaatactccagaaaagatagatataaatattaattcaaatacgaataatggagaaaatactgaaaaacctataaatcaagaaaatcaaaatgttaataatgtagaaaataaaaaagaaagtcaatcaacacagaatattcaaagttatgaaaataaagaaattaaaaatcaagaaaatcatcctttacaaagtaatcaaaattatgaacagaccaatggtaattttaatgaagagaatgaaaatgccatgactaatgttggagagtcagaagtaaattataataatgaaccagcatataattattatatcgaaataacttatccagatggcactattcctgataaaatagaagaacaaatgttgtattatattaaagtcattgacccaatagttggagggttagcaggaattgacatatatgttgatggcaactacattggaacattagatgatgtatacgggattgtagagtgtgtattctatgagccaggttatcacacaataacagcagaagataatggaaaaattttagcatctaaaactgtatatgttgaggaagggactgcatacaacagtggagaatccgaaaattatgatgagtatgataataattatgaaagcaatgacttacaacaaacacaaactcagttttcagaaatagaagtatatgtggatgatataaaacccagtaatagtattataattacaaaattagctatgaatccaggttttttagcatcaataaatggaatctctccagacattggtgtaaatatagaaatggaaaatggagaaaaaataaatttaaaatatgtttctatggatgtagatttaataatagataatccaaattcagagagtataacaatcgataaaataatcttaaatatgtttgatgatgaaggtcatagtttaggacgaggagaggtatcaaatatagtaataacaccaggagaaaatccagtaactgttaaagtaaatataccgattaataagatgggatatgaaatccttagaaaattaagtggagaagaagtttttgctgaaatatctggaagtgcatatattgaaggcagtggggaagtcccatttagtggagaggcggatttattgccaccattacctacaccaccattcccactacctccattgccaccatttccaactgaataacaaaattttaaatcttttacatttttatatctccaaatttaccaataaccgaaaagtatatatactacttattattatttaatttttgcttctggtggttgtagggcggtggctcagcctggttagagtgctcggctgataaccgagtggtccggggttcgaatccccgccgccctaccatattttttatttccatagggctatcgccctattgggatacccagagcggggcttcactacgttcagccccactgtaatctaagagacattgccgagcaaagcgaggcaatgtatcctgttttgatgaaccttttactaaaaggttcgtttgaatccccgccgccctaccatttttttattttagataataatatttgttaatttagttttatcaattaataaaactaaaaataaaaatttaatttttaaactgactcataaactttggaatatattttatagccatatccaaactcataacctcatagttatcttttagataacctttttctctcataactcttcctacccaatctgcgaacctcttatcctgtataactacaactccataatcattctcagttcttattaatcttccaatcatctgaaccaatgtccttgccattctatcaaatgatgtcattaaaaaagctctccaatgagcatccctaactcctctaattttaaatctctcttccaatatcttctgctctctcaatattaaaggagtgggaactgggaatggaagggagtcaataacaactccaaccaatgcctcaccaggaatatctactccttcagcaaacctcccagttgctaacaaaattcctccaatcttttcaaatctctcttttagctctttagcttcttttccatccataccttgctcatacacatggatatttttatttttaatatttgtttttgtaatctccctttttagatatttataaaaactatctaaatcctcaaagctcttaaataaaactaaagagtttccatttattgcttccaatatttttaataaatttttatttgctttctctctatctttcctttcgtatttcatatcaacgccatcttttaaagctataattttcttcctattctttggaaatggactctctaaaattaaaaattctgctttatctaaacctgtctttaaagcatgcatctttaaatttccaattgttgctgagcagtggataactacagcatttccataaagttcttttagatgagagcttacaaaaactggctcacataataaagaatttccacttctataaactacataattttcattaatatatcttaaatttttaatattttctataaattccaaaagatataggtcagataatttctttttatggataaaatcaagctctatagctattaaagctttattgtcaatttcaaatctaagttcctctctatcaatttcctcattttcattaaatctcaatattttattctttatgttgtttatttgataatatgcatctaaaatagcccctaatacagcaagttctgtcttatatttccaagagcttaaattttctccatcaaaaataattgtctctttgcagatatctatattgatgcctctacttgttaaatatttttcaataatttcccaaaaattttcgtctccaatatccaatctcttttttaaaatattgggagcataatgtatagccatatattttaatctattaattggtaattctggatttataattattgttgatgtatttcttatactgctttccaatttatgggcttcatcacaaataattatatcaatatctctttttgcctcaatatcttccttagcatagtaaaacatactgttattcataaccacaatatcagctaagatactctctatttttgccttttgatattcacaggtgcagtatgggcagtagtaaataactttatcccctaaattcactggttgtttttttgttccacaatagcaaattggtcttttatttggtctatataagcattttttattcaattggcaatatagtctattagcctttcctccttttgatttgcaaataaagttactttttcccattaagaatgcaacctttaaattatgccttagagaacttaaatcctcataaatcctaacctgctggtctatcgtttctgttaatattaaaactctctttcttctctctgcaaagtataaagcaggaattagatagcctaaagtttttccaacaccagttggtgcttcaactatcaaatttctcttattttttatacactcgtaaatttttagcatcatccttttctgtggctccctaactttaggatatggaaacttctctttaatataccctttaaattccataaaaatccctttactttaaattatagaaaaaataataaaaaagaggaaatattattctccatggtctttgtgaatattttctacagccttgttataatattcaattgctgcttcgatatttccntgcctctcatagattcttgctttactcaaaagtgcctttatataatgtggttgtagttcaataactttttcatagcattttaatgcttcatccagctttcccaatctctcatataattccmctttaaaataccataaagccacgtcatcttttcttatctcyaatcctatatttatgtatctttcagcatcttttaaatcgtcaagagctaacatcaaagaaacagcatgtcttatggcatctatccattttacatttagttcatctatcaattttttgaaacattcaagtgcctccctaaatttacccattctctttaacaaaacaccttttaaatataaggcatttttatcatgtggctttaactctaaggctctatttaaacatagtaatgcatcttcatatctccccaattttcttaggatttcagcctttttaacccacattgggacaaagtttggagtatatgttaatacctcattatagcattttaatagttcatcatactctcctaagaattctaaacaaatcgttttgagtaaaaatgctgataaaaatctattttcaatgcccaacgctttgttgtaacactttaatgcttcatcacaatttcctgacattccatacagttgcccaacaaacacccatgtaattggattttttgattcatagcttagcaattcttcaaatgttgtaattgcttcttttatttctcctttagcggataatgctaatcccttcaaaaacaaagccaaatagaaatcaggctccaattccaacgctttatcaacataataaagtgcttttattaaatttccctcaaataattctctataagctcttaaaacattagccacggcttctaaggtatccactcttggagttctctttctattcatacgcatatcaccataaaaataaaggataataattttatctatcaagtgctttattgtagcactctatagattcctctattcttccaagtttttctaacacccttgccttagcaagtaaagcttttgtgtgatgaggcatcagctgaatagccttattataatattttaaagcttcttcaaatttattttgcttttcgtataatttacctttaaaataccataaacttgcatcgtcgggccttaactttagtcccatctcaatatatttctcagctttatccagtttattaaatagaaaggataagtaaatagcttccctaataacttctatccacgttacatttagttcatcaataagtttttcatagtattttaatgcttcatcacaatttcctattctatttagtattaacgcctttaaatatattgcatttgtatcattttcctttaattctaatactttatttacacatgctaaagcttcttcatatctccctaatttacgtaacatatttgctttaattatataggcaggaatgaaatttggagcgaacgatattaatctatcacaacactttaataattcgtcatatttacctgaaagtcctaaacataataccttaaggaaaaatgctgtagcaaatttctcttcaatacctaatgacttctcataacattccaaagcgttatcaaaatttcccaatagctcgtaaagttggccaagaagagcataagctaccgggtcatttgaattacttgtaatatcttcaagacattctatagatttattaatatcacccaaaattgccaaagatatcgcttttaaaaattttgcaaatttaaaatcaggattcaactccaatgctttatcaagataatataatgattctaaaagatttcccctgtctctatattcatatgattttattaaataagttaatgataataaaacatcagaagtttcttttaattttttattttttatttccatatttatccaccaaatagaagattggagttatttgtaatatttttatatcacaagatttcggacactcaacttattattatcgttaataatccctatattaaaattatgtatcatcatcagaaatactataggacgttccacagaatataatctttataaagaattgaatatttaaaggcatctaaatatcttatattaagtatatgaatatgaaagtcctctaccaaaattgtggatatagagttttcatcttttattatgatttttattatgattttataagaataatatagaataataatgcttatagtttggggagtaacttgatttttaattgtggaagaaatctatcttactaaagcgagtattatagctatttcaaatttaaaaataattttttatcaacttccccctctcccttaaatacattcttgtatttggtcaaataatttcctatatttatgagcttattaacctctctatagaaaggaagttttctaaaatgttctcttctatttaattctaataggtatctcaaaatttcctcttcattttctttagtattgtatctttgtagattattctttatttcatcaatctcttcgagatttaatttatttattttatttccaaaaatttctctacatctttcaaacatctcatcaaatgtcttactgctaaaaatatatcttccaaaatcttccctctcttcccaatcaactctaaaattttcaaatatttctgtcttactactatgttccattccgttctctataatctcttcaaacatatcaaaataaagctcttttattaattctatagcctcattaacaacttttttactgatttttccttttttaatgccactacaataatgttttataattaggagaggagttccatcccatttaatcatgcaactgaaaggaaaaatcatgcacatcaatggtttaaactcatagcccttctctaaatgaattctacataggttgttatttaataaaacacaacccttttcattaacttttagcctatatttaaattctccttcacaaggttctatggcatattcgtaatctttaagttttaatctatcaaaatagtttaaatatatcctccaacctttacatgagcaacagtaagcacaatttatgcattcataggttattcccttaaaggttatctcccaatccatgggcatcactttaaatataatttttatgatattattttatatttgacagaattcaataaaattgattataaaagttatggtgatgttattgatagagcttacttatgcctttatttttgttattattgcagttcttattgcatatagggaaaagttgggcattgagaaaaaaatcctttatgtgtcaattttagctttaatccagctgtttattttaggatttgttttgctctatatattttcatttggaatggttggggcatttttaatgattggtgtgatgattaccttagcatcctatcttataatgagagaaattaacttaaaaaataaaacaaaactctttatttgtctatttattacgtttttaacaactacaatagtttcattggcagtattaacaattccaaaggttgtcaaatttgagccgatatatgtaattccactaatgggaatggtcattggaaatacaatgaacaccatccatttagcattagataaaataatagacatggttaaatcagagagggatattttgtggggatatttagctttaggagctactgaaatagaagcattaagaccatttataaaaaatgctgtaaagtcagcagtaatacctcaaatgaatagaacaaagtcagttggggttatatttatcccaggggctatggtagggatgttgttgagtggagcaaatcccatatatgctgcagagattcaaattatcattatgtggatgattctaagctctgcagtaatttctgggattttgatatgctacctaatgtataaagagattattagagcataaaaaaggttttaaaatttaattaaattttatcttcttaattcgttcatcttctctattctctttttaattaactcttttttaccaatatcacttctgtgatatacttctcctttaatatatttagttgcctcctcagcaattctctcagcttcttcaattgtatcagcaactccaaccacagcaacagcccttgaaccagtcatatataaagacccattatcctcattaactgaagcataatgcaatatagctccagttttcttaattgcttcttcatcaacagttattggctctcccctaactgggttatcaggatatccctttggaacaacatacttacaaacagtagctttgttttcaaactcaacgtcaatatctttaagttttttatttactattgcctcacaaacctctaagaaatcattctttaatatagctaataagttcattgcttcagggtctccaaatcttgcattgtattcaataattttcggcccctcttttgttagcataaactgtccatataaaattcctttgtaacctccaacctcctcctttaatgctttaacagtctcttccataatctcttttgctaacttaacatcctcttctgtcataaatggtagtttatggtctgggcatgagtaagaacccatacctcctgttatacttccttcatccccctctaatgcatgtgggtggtcttggacaaatggtgtaaatttaatagtatctccatcaacaaatccgtgtaaggtgaattcaactccttccaatttttcttcaattaagacctttcctccccctaaaccagtttcaaaaatctctttagcatatttctttgcctcttcattatcttttagctgttctccaactaccttaactcctttacctcctgtcaatccaacgggtttaacgactgctttaatacctttctcagttaattcatcaataaagctttctaactcttccccatactcttcaaaagctttatacattaaagaaccttttatattgtattttttgaataaatttctcatgaattctttgtttgtttctatttgtgctgctaactttttaggaccaactgctgaaattcccatttcctctaacaaatcaacaacaccttcccctaaaggagcttctggacctataacagccaaatctggtttaactttttcagcaaactctttaaccgcatctaaatcagtctctttagctaactttatctcttctgataatcttgcaattcctgggtttttgtttttcattaatgtgtagagctttacttcttcattcttttttagagcgtgagctattgcactctcccttgctcctcctccaatcaataaaattttcataatctcaccttttgcttttggattaatgtaataataaaaaagtaaaaaagtggtttaaatcttttactctaacactatctccctatactccttcttttcagtgtctaatatcccaatggtaggaatgccagttaagtaaccgcaacattctcctgggtttatgactaaaacatcatcaacctcctcaaaaaccctctcatgtgtatgtccataaataacaacatcatacaaaccagatttaatagccatctctaaaacagattgatgatgcccatgtgttataaagaattttaggtcatcaatttcaactgatataaaatcatcaattatgttctcttcatttatatccttcaaccattcctttaatttgcatctctccccatcgttatttccataagtggctatgatattggcgtttaagttttcaaactcttttataacaaacaaactaacaaaatccccacaatgaataacagtctcaacattttcatcattaaaaatctctatagcttttctaatattgggtaagtggtcatgggtatcgctcattatcccaattttcattctatcgcctcgaagatattttataatggagaatattttataacactatctatgtcattatctcttatataacaattttttaatgagagaaatattatttcttttttaaatattcaattgcttcagctattaaatcaaccacatactttacattttcacttttaattattacactgtctgatgttgcaacaacttctttatttttaagctcgtagtcacaatttttaacacaaaaaacctctccttcaatactaaaagctttcattttttctctaatctttttagccaatattccactttttgatacttgtgcatctaaataaataacagctttaatattgtaatgcttaagaatctccaataaaagagatatggctttgtcactgtattcatttatcttgtatttaccataaacgttttcaaaatctctgtaaatattgtcatcacataaaacaattttatttcctttaattaaagcttctaaactaataagaacattaaaaccatctatgtatatggtttttcctttaaaatcttttaattttttaagctttcttttagttaatttaatttctttatcgctgtgagtagttctaataattttaagcctatcctctttacttaacttataatgatttgctacaaaatttaaagcaacatcctttttatagcccctatttatcaaatatttaaaatcttctttagctttctctatgctcataatttccccttatgggacagatttcttcacattccctacaaaatatacagctgtctatatctactttaacaattaaggagtttatgtattcatcgggtgtcaaaatagcttgtaatggacatttttcaatacaacttaggcagagcttgcatttctccgggttaatttctttatttattatatcgatagcttcacattcacacaacccacaactgttacatctatcttttaaaataacgggtgtttttggcttaggaatttctttttttattataggtattggacaaaataaaacacaaactccacattttgtgcatttatcagcatctatggtaaatctatcttttattattgcgttgtttgggcatacatcaacacaagttccacaaacagagcatatggtttctctaaagctaaatatttttattgcatttgtagggcatacatctacacataaaccacaaccaatgcactcagttaattgtataggcttagtttttgaaggttttgaaaacttattcctatttgttaaaaaaatgcttcttattaaggtttttatcaatcctgcccctttaaaaattttgtaaaattcttcttccataaacctcacttacttaagatattttaaaaatatttaaatttatcgattaattgttctaaaataaaaagaagcccggcaaatggcgccctggccgggatttgaacccgagtcacgggagtgacagtcccgtatgataggccgggctacaccaccagggcatagtaatgccaaggattaccttgagaatttaaaataataaaaagtggccggcggcgtcgcccctttcccgccagatggcagtactcggggcatcgctggggggcttaacttccgagttcgggatgggttcgggtgtggcccccccgctatgaccgccgtaccaaaggaaatagcgggcccgaagggatttgaaccctcgaccacctggttaaaagccaggcgctctgccagactgagctacgggccctcttcagcccttagctcgtgcgcgtttcaaacatatcgcatttctcatatatatacttttcggttctccccataaatgggagatggtccggcgggccggatttgaaccagcgacatgcggatctacagtccgccgttctaccaggctgaactaccgccggacacgaagtggtgggcctgcccagatttgaactggggtctcaggatcccaaatcccaaaggatagaccaggctaccccacaggcccactgaagaagagaatggagccccgggggggatttgaacccccgaccacctgattacaagtcaggcgctctaccaggctgagccaccgaggctcgtttgcagtattagtaaattacagatgttatatataaacttttcggtgattaaatcatttagttattttgatgtattttaacccctacagagtacaataaatcaaaactccaattattccaccaacaatagtagctattaaattaacgtgttcattatttaaaattccttttctttcaaataatgccccaactaagctatcagctaagttcccagctattccaccagctgtgccacataaaacaattttaatatcaccaaatagtaaatatccaaacaaccctattaaaaacgctcctaagactccagctaatgtaccaaatattgtaattgctccatcagttcctttttcaacaacttcgaaggtagttattaatctcggcttttcgttagataatattccaagttctgaagaaaaagtatctgatgtagcagcagctattgatgatatgtatccaattaaagcccagttgaatccaaatatagctaaaattgcaaataatattggaattaaaccatttgctaatacattttttaaacttctacaagtttcatccatttttttagctttctttttttctaaaccgactctactcaccaaaacccctaaaataaaaaaagatagaagtaatatcaaatatttaaatccacagaaataaagtaatataaaacccataatagatgatccaatgactccctcattatctaagcatctactctttttaatcatcaatgccaatacacatataattaagatagatacgaataatcttatcaaggtttccattgtatcaacttccaatataaattaaatgaggccctggccgggatttgaacccgggtttggggatccgaagtcccccgtgatatcctctacaccaccagggcttaataagctattatatggtatttttattttttaaattaattttaataactttgagagcctatactgataactttccccaaaattaataataacaaaaagctatacgaaaaaccaacattaaattttcatgcaagaataaaaataaacaaaaaaataaaaatttaaaaaattcattaatttattgttttaatgctaattttatgtcttcgacttttactgtttttctttttgcgtgcttagctaattcaactgcttcttttgcaatctctaatgcaatctcttcaactgcttcagccaagtattctgcagctgctctgctaactctctcagcacctgcttttttcaagattctttcaaatggtgcaactggaagctcagccataataccacctcagaagttttacaaggattcttttattaaaatagggtatttaaaattttcggtttagatttagtgtttatgatagtttatcttataaaataaaaccttatattgggaaataggaatttttataaaatgtctttatacaagtttgactttttcctttatttttttgacttcttctggtttagcaatggtttttggatgttttggaagatacggacattttatttctttttcagtagatatttcataagttccaatctctttagctattttcacaatatcattcttatctaaaccaattaaaggccttaaaattggataatttatattttcacttatgactctcaagttctttaatgtttgggaagctacctgccccaagttatctcctgtaacaatagcatcacaatctaaatattttgcatatttttcagcgacttttagcatttttcttttacagaatatgcatgtataattctcttttttaatacttttaagtttttctacaatatcctcaatatcttttttgtaatcatagacaacaaactccaattcggtatcatagtcacttaaaacctcaacaatctttctaactttatttaatgcttcttcactcatctttaaatgtaacaaaacagctctacaacctcttctaatcatcataaatgcagctacagggctatctattccatcagatattaagcagagaactttcccctggcttcctgctggtaatcctccaattccttcatatttttctgtgaaaatatatgctccatcatttaaaatctctattcccaaaacaatatctggattttctaaatcaacttctaatccgagcttttcaactatagcttccccaacttttttatttacttcaactgatgtgaatgggaattttttatagctcctttttgttttaactgcaaaagttactttttctttatttagagtttttaatttcttcttcataatttgaactgcaaaacttacaatttcgttgatatccaatggacactcataaactggactgtaggaaacaataccagcaactttttttaataactttagagctaaatcttctttatcttttgtgtttatcttgactaacaatttcctatgtaaaattttaacctctgcatcaatctcatattttctaagcaattttataatgttttttcttaagatttcctctaagttttttctaattgggtctgattttaatccaatttctccatatctaactaatatttccattttactcaccttaagctttttcattttttgcataggcaataatgccgttaattatggcaacagctactggagttcctccttttgggcctatggttgatatacttggaacatttacctctctaagtgcttcttttgattctgatgcctgaacaaaccccactggaactccaacaattaattttggttttatattttcttctttaactaatcttataacctcaaacaatgcagttggggagtttccgataactacaattccatcatctatcaaatccttagccaatctcattgaagctactgctcttgttatcccctcttttttagcaacttcatagacatctggatgatttataaaacaatgtactttattatatctaatcccagctttaatcatatttacatcaactattattggtttttcttcctttatagctttaattccttcctctattgggttatttttaaacactaaaagtttggcatactcagggtctgctgtagcatgaactactctttcaataattcccatttctttttcgttgaattcatttattctgtctcctaaaacctcttttattttatttctaacgatttcccttgatttatttgctatatttaatccatcttttgatattgctcccataaaatccataaaaatcaccaaaactgaaaatatagaagttaaaaatagaaaaaataggataagccattatttttagtactttttattctttagagttttaataacttcatcaactatctgtggagctaaacctatgtaagttttaggattcatcaattcctctaactcttcttttgttatatacttcataacttcctcattttctaataaaatatcttttaaatgccttttctcttcataggctttcattgcacactgccttactatttcatgagctgtttgtctgcccatacctctcttagccaattcaatcattattctctcagccattatcagtccttttgttaattctaagtttctctcaacattttctttatttacttttagctttttaactcctttaattgctaatgttaagatgtggtctgttaaaacgcaaacctctgcaaatatacatctctcagctgatgagtttgttaaatccctctcttcccataatgggatattgtccatttcagctatacatagtgattttataacccttgataaaccgcagatttgctcaaaggttattggatttctcttgtgaggcattgttgatgaaccagtttgctttgtagggtcgaactcttcttctagctctccaatttcagttctctgcatacttctaacagtaactccaatcttgtttaatgtctgagcaattaaagctaataaaaagacgaattcagcatgtctgtctctctgaataacttggtttgagattaaaactggttctaagcctaagatttcagcaactcttttatgcacttccaaacccttctctcccatagccgccattgttccaacagctccagtaatcatagagacgcatattctcttttttgcttcttttaatctctctaagtgtctgtcaatctcagccgcccatagagcaaatctcatcccataggttgttggaattgcatgctgtccatgtgttcttcctacacagacagtgtatttatgctcttctgctttgtctaataatatatctcttaactgctttaacttatcttctataatttcaatggattcttttattagtagggagttggcagtatcaacaatatcgtttgatgtagctccgaagtgtatgtattctccagcatttccttcacatacttcagctaaagctctaatcattgcaacaacatcatgttttgtttgtttctcaatttctttaactctctccaattttacatattttgttgatgcttttttgtttatctcttcagcggcttcttttggaattaagccgagttctgcctgagctttagctaatgcagcctctacctttaacattttttccaatttattttcttcttcccaaacttttctcatctctggtgttccatatctataatcaattggatgcacagccattttttcacctgactttattatttgattaagttccaattaattgctaatgatttttatagtttgatgtttatttaaaaaagcattttcagaaaattacttatagaagtctgtttataatttattatttgggttttaggatttttaattttgttgtttggttaatggattgtcttgttgaatatgtttggattttgaaaataagagcatttagaagttattaattagttcaaaggatttttatttaatttctaagggtttgctggtttgattatttagaatatttaagtttattgaattattcagatttttgaaaataaaaattaaataattatctaaataagatttctctaacagacaagttaaatttttgaatttaaaaagataaaaatgcttagttttagtaaagagataaaattttaaatactaaaaggtttatattgtaagatggttatttacccttagaaaaatatggtatagaaaagcttaaatattaagagtgatgaagtatattatgttgtgaatgattgccctgttaaaatcagacctcttggaggatggaaaaaacatcctctcaccttaaaaagttaaaaaaagaatttagttaaaatcagacctcttggaggatggaaacgatattaggagtcagtgtaggagaaagatactctttattaaaataagacctcttggaggatggaaataactatcttatacttttggtatctattcatctttttattaaaatcagacctctaagaggttttaaacttggatatattggaataaactcaactttttattttattactgtaaatccacatatttaaaaatataataacaaaatttaaaatcctcaactcacataattcttcttggtgagaattaatgataattgagatagaaggaattaaactaaaactacatcccgaagtttatgaacctgctgaagattcaattttattactaaaaaaccttgtagatgttaaaaataaagatgttttagagataggtgtgggaactggattaatatcaattgcatgtgcaaaaaagggagctaaaaaaattgttggtgttgatataaatccttatgctgtaaaattagctaaagaaaatgccaaactaaataatgttaatatctcattttttgagagtgatttatttgaaaatgttactggaaagtttgatgttatattatttaaccctccctatttaccaacatctgaagatgaaaaaatagacagctatctaaattttgcatttgatggaggaaaagatggaagggaaattttagataggtttatctatgagttaccaaattatttaaaaaagggaggagtagttcaaatattacagagttctttaactggagaaaaagaaacaataaacaaattaaaaccccttggttttaaagttgaaatatccgcccgtttaaaagttccatttgaggaacttatggttataaatgcatggaggttgtaaatatgaaagctaaagagattatagagtttattgaaacctttgctcctaaagatttggctattgagggagataacattggtcttcaggttggagacaacttagataaagagataaaaaagctaggtattgccttagacccttcattatcagttattaaaaaagcagaaaaagaaggagtagattttttatttacccaccatccattattaaaagaccctataagaaattttactggagttatttacaaaaaactaaagatattaatggaaaatgacatcatcctctactctgctcatacaaatttagatatatgcaaaaatgggttgaatgatgctttagctgaactttataatttagaaaatccaaagcccttatatgataatggacttggaagagttggaatttttaaaggaagttttgaggaatttttggagataactaaaaaatacattcacaaaaaccctattgttgttaaaagtaaagaggtagatgacaactttaaattagctgttttatctggttatggattgtctcaatcatccataaagtatgttgctgagaaagcagatgtctatctttctggagatttaactcatcattcaaaaattttagctgaggagcttggtttagtggttgttgatgctactcattactcaactgaagtttttggattaaagaaatttaaagagttcttatcttcaaatttagatttagaaataattagtttagatttctaattttaatttaaaaaagtaatattcagtataatctaatatcaattctatattccacgttgtatggtttagcctctaaaatttccattaatcttttctttattggttcaatttttacaggttttttgataaagagttttttctgtattattataacatcacatgtgcagatgtatttattattgcatctctcaattttaacctttaaagcatagtcttcaattaaatcttggtcttttaatatagataagatatttttatctaattcattctcaattgaaagttccatatcctttatttcatcatctgttaatattatatcctctccataatcaaaagcctcttttattatattctctatgaagtcctcatctggctctttaattcctaattgttttaaaagttcttctcttgataatgttccacattaaatagtatttaaattcatagtgtttgtttttttagttttctttttttgaactcttggtattgtatctacaacatcataaacaattatttttctgattttagtatttcacgtaaatcctgtaagcatttatctagtttaatcttcatctataacagcttcaatttttgtaaattcctctaatacttctgtttcatatatttaccccctatattcaataacaacctttttactacttttttcttttatatctgaaactacatactcatctataatagtgtatcttttcaaaatatttatgcagggtagaattttttcttgaggtagaattacttcaactaatttcatatatttcaccctaataatttaagacattaataactcatttctttgaaaggagttcaaattatccgtatctttgtaaattttaactttttcataaacaataataaattaatcaaccaatgaaaacaatactggaaggaaggaaagttccttccttacttatgtcttaatagggtataaaaagattactaataacactatttaaaaatattcaaatctaaaaataagtaattgtaggtaaattttaaatacgggtagtaatctaaagtattaaactatataaacctaaccataatgaaataaatggaagaaaataaattgtcaaagtttagtaaattttattaaaataaatttagcgtgggattatgtcaatcttctatgtgcttggaaagaagggaacgatagagatattatataaaattaaagagggagtaaattccttcacgagcataaaaaacgccttagatatggaaggatgtggggttagcacgagaacattggcggaaagattaaatgaattggaggatgaaaatttaatacagaaagatggaagtaaatactatttaacaaagaaaggccaggaagcattggaaattattgaaaatgttatgaaatgggaagcaaagtggaaagaagcaaaaattccaaagattataataggaatgcttggagacaaagaaagataatcacaaaaaacatgctgttaaaacttaatttcctttaaatgttttgttaaacgctttttggaataattcttttaagcaatagttgaataaataattggattataggtggatacaaatgaaggtaatcacattctcaattgcaaagggaggaactggaaaaacaattatcacagcaaatgctgcagcagctttagcaaaaaaaggtaaaaaaatcttactaatcgatggagatgttgggtcaaagtcattgtcccatcttctaaatgtaaaatcaaacatatttttggcggatattatagaagaagaacgtccaataaaagatgctatcgttaatactccaattgaaaatatcgaattattggcagttggaaaatcacttgccgattacttaaaattcgacataaatattttaaaaagatttaaggagttaggagattatgattatgtgtttatagatgctccatcaacatcaagcggtgttgaaacctacttagctttaggtctttccgactactttatcccggttttggattacactgcctttggtccaagtttgcagggggctataaatacaatagttattggaaagaactatttagaaagcacacctgcagggtttataataaacaaagccgaagatttgccagagagtgtaattaatgatattaagaaaatcttaggattagagtgtatatccataattcataagaattcccttgtagaacagtcttatgcaaaaaaggaaatagtttatctaacctcttcagacaagaaatttgttgaagaaatcgacaaaatcgttgatgccttagaaaagttaaaggaggtaaaagaaagggatattccaaaggtcattgagaaaataaaggaaagcacattattataagggctttcgtagtctatatataaatttttgaacttatagtgtttttcattgattttcatctttatcgattttcatctttatcgttattgaacaccactacttccacaagtgtctttaaaatttctttctgttcttcttccgacggtattttaacattatatttctttaataactcttcatctacattcaacatatttttgcagtttatttttatttctttatcaatataactttttaataatttttcctttaattttgtagcattttttaagaaacatttgctaatttctattgcaaaaattacaaaaaatgcacctattacagtcattattaatctctctttaataaagagaggaattactgaaatgtaatcctctgctggcaaatgtaaatatacaattcccaaaattgaaccatatagatggtctgtcatcaccgatgagaatgataaaattgtagccccaactatcatttttttccaatctttactaaacaacaatttacttattttttctctaaaaatgaggataagtaataaagcaagagttgaaaggtatgggtaataaaaagctaccctccccacatctgttaaataaaatagtaataaacccacaattaaaattatagctgaatatttccatttcccttcagataacgctccagcagatataaccgctaatgtaggaggtattaaagaataaattccaaaataaaatgcttttggatttaaaaaaaagtatattaatgttaccaacataactgcaaaaaatccataaattggacccaataaaagaccacatacagctgataaacttggatatgcattaattttatgacttgaacctatcatctgaaatttaagaaatgggataaatataaataaaaaagaaactgttccaataaacattagaaataacatctttctatcttttcttaagagtttaaatatttccataatatcacatagccactattggacttatttagtccaaatgtaatataaaatattttctattaccttctgactatataaatgtgttactatttaatatttaaccaaactaagttatataatagttcttaaataatgtatttaaacctaaaaatttttgatccaaaacttttaaaattttttaggtgttataaatgattgatactcttaaaaatataaaagtaaaagatgtaatgacaaaaaacgtaataactgcaaaaagacatgagggagtagtagaagcgtttgaaaaaatgttaaaatataaaattagctctctaccagtaattgatgatgaaaataaggttattggtatagtaacaacaacagatattggctataatttaataagagataaatatacattagaaactacaataggagatgtgatgacaaaggatgtaattacgatacatgaagatgccagtattttagaagcaattaaaaagatggatatcagtggaaagaaagaggagattattaaccaactacccgtagttgataaaaacaataaattggtcggaataatttcagatggagatataattagaactatatcaaaaattatataagcattattaataaatattaaactattttcatatcttattacaattttcataaaattcaaataggactttctgtagttttttataatatcatctttgatagaacgttcgtagactaaaatttatcattgcacaaaaaagtgacctaatgttttaaactacaaaaaagttctatttggaactttaacacctttgtacatccatatacaattacgtcctatacaataatgataataaaaaataataaaatttacctctgcgaaagtcctatttaaatatcacaggtgattctatgtcagtaaattataaaagtgtcattgcaatggtagatgatgccttaaaccttgttgagatagttgaagaacatccttgtccaaacggtagtgaatgggttatctatcaatatcaaagaacctctcctctaatcttatcagcatggagagaaggaaacaaacaccactttgtaacaaaaattggtaaagaaaaattaaatttagtcccttcattatcggcagcaggaattgaagaagtttatatagaaaataatagagttcatattgtctatgcgggattagctggaggaggcgtaggagctgagttaaggaagggagccaaaaatgtccttgaagtaaatattttagaaaagggaggtggttcaaggcttggaaaggcagaggttataactccaaaaatggaaaaggttattattggaattgatgacacagatacaaaagaagaaggagctacatgggttttagcacatgagattggtttagaagttgagaaagaagggcttggttattatttagaccatacaattgttcaactttatcctggaaatccaaataaaactcaaaactgtgtctccatcgctttaagttttgcggtctatccagaatataaatacaaattggataaattcattaaaaaattattaaaagaaagaagtttatcagatgaaacagcaatggctgtttattatggccttttcccatcaaaaagtatgaagctctttgcattaaaagctaaaaaagaaatggttaaaatagaggaagcaaaatctatagctttaagaaataacataaaaataattccaattaatggagaaggagggataataggggctgttgctgctttaggtttggctgagcatcactcattagctccaaagttgtgtgaagacattaagctataatgtgagactatgcaagataaagagtttaaaatagccattattggcccagaaaatgctggaaagtcatcaataatgaacgcattgtttggaaaatatgtttcattagtgtctgaggtaggtggaactacaaaaatgcccataaaaagatactggggaaagttgaagattgggagaattaaggaggagccagaatttgtgaatttagtgtttgttgatttgggaggattatatacaacaactgacaaacaatccccaattatgacaccaaaagttttagaaaagacgtttgaggagattaatgattcagatatgattatacatgtaattgatggcagtgttggattattaaggagctttgagagactccaccacttgttaaaattcagataccaaaaacctattatagtggtaatcaataaatgtgatttattaaatgatagtgataaagaacatttaaagaattatgttgaaagaagaataaaaaatactccaatatttgtatcagcaaaaacttttgaaggaatccctgaattgttggatataattattaagtatttgaaaaggtgatgcaatgttagaaaagctaaagaaacttttgagtaaaaaaggagataatttctcaacccccgcaccagtatctgtagatgactacttagaagaaattgaggaaatcccactaactccagttgaagaagagaaagtaattataaaggtttgcagtattgaagatgaaaaagatgctgtaaatgctatagtgatggctgaagcgggatatatcgttatagcaaaaactcccaacttagagaaggagattgatgatgaatttatcgaaatcatcagaaagatgagaaatgaagttgcaaaatttggaggaatgttattggctttaggagatgaacatttgctaataaccccaagaaatgtcgttatagaaaaacttattaaagaaaaaaaggaagaaagtaatgttacaaaagaaaacatagaaataaaagaagaaaaagaagaaaatagtgaataagagcttatactattattttattttatcctaccttttttaaatagcaattctttttattaaatgtgataatatgaaagtcttagatgaaattgtagcaaatagaaaaaaaatggttgagatagaaaagagaaaagacataatcaaaaacttaaggagttttatcgatgaattagatatagatgtagaaaaaaagagaaagttaagattatcaaaagccataaaaaaagctaaagaaataaaaaacccaataattacagagattaagccatcttctccatcaaaaggtagcataagagaaataaatctcgaagatgtaaaaaatattgccaatgaaatggtggaaggaggagcaacagctttatctattttaactgaaccaaaatacttcaatggaagttataaaaatttaattgttgcaagagaatttgatattcccatattgatgaaagattttattgttgatttttatcagattgatgtagcaagtgagattggagctaatgcagtgttattaattgtttcatcattaaaagaagacattggagagtttttagattatgcaaaagaaaatgatttggaatgtttagttgagacgcacagtgaagatgaaatagatatagctttagatgctggagctaaaattataggcataaataacagagatttaaaaaccctaaagattgatttatctacaactgaaaaattggccccattaatcccaaaaaataaaataaaggttggagagagtggtatatatacaaaggagcagttaaattatgttttaaaattcactgacgctgctttaattggctcatcaataatggagagtgaaaatataagagagaaagttagggagttcgtgataaagtaatttatttaattccaaggcatctnctcaacttattataaaaactctgcccctttacaaaataagcatagctgtcggatttttcaaagattaactcatcatctttatttatttcatattcaacacttccatcaataaccaataaagcaggtttttccaatttaagctttagtttaattctatttgacgcggaaatcactaaaggtctcgaagataacttaaatggacatattggtgatattataaagcaatcaacgtttggttcaacgataggccctccagcacttagagaataggctgttgaaccagttggtgttgagacaattattccatccgccctaacattttcaacaagcgtatcattaacatatacatcaaattctaaaatctttgcagggttttttgtaataacaaccatctcatttaaggcagagggtgtttttataactctattatcttttattattttgcaagataatttacttcttttttctatctcatactctccatatattaccttatcaattatttcaaaaacttcatctttacaaaactcagctaaaaatccaacttttcccatatttacagctattataggtattgtctctccattaaccaatcttgaagccctaagtattgttccatccccaccaatagcaataatatgagagattgctgaaatatcaaacttatcgccaccaactctctctcttaaaaagtcctcaacgcagaaggggatgtttttatcttttagatatttacaaatctctatagccaagttaattgcctcttccttatcctccctaacaactattccaaatttcactggctttattatccatctgttgccaaataaagctataagctttttatgtaaatatttattgctaacaattaaagatgttctctccattaaatgtaatttcatatttaatggtttcccatttttgtttgttacaattgcatttccctctctgcagataacataagccccagctatatcgcagagacgagaattttcatttacgtttatataagcgtctaaagccccactaacaacataacacatctccaaagccatagaaccaaataatctgaccctcctaaccttcctttcctttaaaaattctaacaaatcattagataacccataaacaaacaatccaacagatgcttcttttaaatcttttatattttttgtttctattttaattttttccccatctttctctaaaaagcttccttctcctttgatagcataatacaaatctccagtagctaaatttttcacaattccaacatataaatcatttattgtatatttattagctataaaacttttaatccaatctatgttattaatattttctctaattagttttttatcctcccctttaatttttgctacagctattgaagttgaatatatggggatagattttaaagcgttgtatgttccatctatggggtccaagataaaaatatactctaactcatcgccaacaactttcaatccaatttcttcacttattaaaatccctccactaaacttctctaaaatatttattgccatattttcagcaattacatcaattcttttcgttggagtcccatctgcacctattttaaccacttcatctgctttttcccagccaattaaaggttttatctttttatcaatctcatcaataaccttcattgcaattttgaatccttccataattaccacacaaaagatttaaataaacataaataaatagtaattttttaagttaaaggagtataaaaattagggggatagcaatggcaattagagttagtgatattttagataaaccaatatacacaacgacagccatatacgttgggaaggtctatgatgtaatgcttgatttaaataagggagttattagtggtttaattgtttcagacattcaaaatggatgtttaaaagactatgttaccgacccttctaagraggttgttttgccattcaacttaataactgcaattggaaatataatattggttaaacctcctgcagattctggttatgggttcttaaagaagtaataaaaaaacaataatatattctgtcttttataataaattaggcttattatttatttttctaaaaaattttattttattgtttttaggagggataactaatgcttaaaattggtattgttggttgtggagctattggcaattttataacaaaaaaagttttagatggaactataaaaaatgccaaaatctccgctgtctatgatagaaattttgacaaggcaaaaacactttcagaaagaactggggctaagatatgtagtagtattgatgatttagttaaagaagatttagatttagttgttgaggcagcttcaataaaggcagttgaagagattgcagaaaaatctttaataaataataaggatgttttaataatgagtgttggtgcattggcagataaaaagctgtttttaaaacttagagatttagctaaaactgttggaagaaagatttatctgccctctggagctattggtggcttagatgccataaaagctctgagattgggagagatagaggaggttgttttaaaaactacaaaaccagttgctgccttagaggatgcgttgaaaaaccttggttataaaccagaagatataaaaaatccagtaattgtttttgaaggggatgtttttaaagctataaaagaatttccagcaaatataaatgtttcagttactttatcgatagccgcagagtttccagcaaaggttgttattgttgcagacccaaatgctaaattgaacaaacatgaactatttgttaaaagctctataggaacattgagagtttgtattgaaaatgttccatttgaagaaaatccaagaacctctgcattggctgcctattcagctgttaggttgattagagatttagctgagccagtaaaagttggaacttaaaagctttaattcgtggagaatatggaagagatagaaaaatttacagttattgatttggatagcttagataattttataaaagtagttagatgtccaaactgttcttatgaatttaaatgtgttggagataggtttatctgtccaaaatgtaaaataattataaatttaaaatttcaataaaatttttatataattaattatataaaatattgataaataagtttttggaaatgaaaggatggaaaataataagaatttagagcaaaaactggtggaaagataaagagaaagaaattgaaagaattgaaaatgaaataagaaaaatttaaataaacaaacatataattatagaaataaggtgatttagaatgatttctgcaaaatctaaaacaaaaaggattactataacttttgaaattccagaagatattgatgctaaaaaattcaaagatgatgttaaaagatatgttagatataaattacttgctaacaaactctatgaattattagaaggtgaaaatattgaagaaattgaagaagaaattagaaaaagaagagagtaaaatattggtcgatacttcagttttaattgattattttaaaaaaagaagattggaagaactcggaggagaagcgatttcaataataacagcagtcgaatttattagaggtatttcagaacacaaacaagaacaagttctaaatatttttaaagagttgtttgagattgtttatattgatgaagagataattataccattttcaaaaatttaccgacaattaaaaaagagaggtatgctaatagacgatgctgacttatatattgcatgcaccgcaataatcaaaaattatccattatggactaaaaacaaaaaacattttgagagattaaaagaatttggtttaaaaatatatgataagtgaaatcatgcacccaactaaattattaaaaggaactaaatcaaagctcttagagaataaaaaaatcttagttgctgtaacttcatcaatagcggctattgaaacaccaaagttaatgagagaattgataaggcatggagcagaggtttattgcatcattacagaagagacaaagaagattataggcaaagaggcattaaaatttggttgtggaaatgaggtttatgaagagataactggagatattgagcatatccttttatacaatgaatgtgattgccttttaatatatccagcaacagccaatataatctcaaaaataaatttaggaattgcagataatattgtaaatacaactgccttaatgttttttggaaataaaccgatatttattgtcccagcaatgcatgaaaatatgttcaatgcaattaaaagacatatagataagcttaaagagaaagataaaatttatatcatatctccaaagtttgaagaagggaaggcaaaagtagcaaatattgaggatgttgttaaagcagttattgaaaaaatcggaaataacttaaaaaaagaaggaaatagagttttaatattaaacggagggactgttgagtttatagacaaagttagagttatatctaatttatcatctggaaaaatgggtgttgctttagctgaagctttttgcaaagaaggattttatgttgaggttataaccgctatgggtttagagccaccttattatataaaaaatcataaggttttaacagctaaggagatgttaaataaagctattgagttggctaaggactttgatataattatttcatcggcagcaatatctgattttactgttgagagttttgaaggtaagctaagttctgaagaagagctaatattaaagttaaagagaaatcctaaagttttagaagagttaagaaggatttataaggataaggtaattattggatttaaagcagaatacaatttagatgaaaaggaacttataaatagggctaaggagcgactaaataaatacaatttaaatatgattatagccaatgatttaagtaagcactattttggagatgattatatcgaggtttatattataacaaaatatgaagttgagaaaatctctggatctaaaaaggaaatttccgaaagaattgttgaaaaagttaaaaaattggtgaaatcatgagcaaaagagaagaaactggattagcaacaagtgctgggctaataagatacatggatgagacattttcaaaaattagagttaagccagaacatgtaattggagttactgtggcgtttgttattattgaagcaattttaacatacggaagatttctttaaattatcttcctaaaaataacctctcaccaagccattcaggtaatctatttttaacaatcttctcataagcttttttaatgtcatattctaccctaacaatctctattttgaaatctttttcatcaaatatacagtagcttgccttatttatcccatcccttggctgtcctacactacccggatttatcagatactttttatcctcatctaagtatatttttccttcatgaagcaataaattgccttcttcagaatttacaaatggtatgtgggaatgtccaacaaatatcaaatctccataattaaatacatcatcaacataatcaggaaatagatattcccaaatctctggatgcttaggatttgcatgtgagaagataacttttttgccctttatattctcttcaataattaaaggtagagaatccaagaattttagattttcattttttattaccttcttagtccatagtattgctatagccccatatttattaaagtaatctaagctctcctttcctaaaactccataatcatgatttccaactacacttaaacagttgaggtctcttattaattctacgcattcgtttggattagctccataaccaacaatatctcccaaacaaaagatttttttaatacctctattttttatatcattcaaaactgcatttaatgcctctaaatttgaatgtatatcactaattacagcaatcattgatttcaccataaaattgacatattaattttattaacaaactttttttatctttccatctcagccattattaaaattaattttatctcagcaacattaacgtttaaatataagttaatgcctacctaaaataacgtaaaaagtattataatactcataaaaataaaaaattaatattaaatattattaaaatcttctattaaaaccattaaaagtgtgatgattatgcagtatatttacccatttacagcaatagttggacaggaaaagatgaaaaaagcattgatcttaaatgcaataaatccaaagattggtggtgtcttaattagaggagagaaagggacagcgaaatctacagcagttagggctttggctgatttactcccagagattgaaattgttgaaggatgtccattcaactgcgacccaaatggaaacctatgtgatatttgcaaagaaaagaaaaagagaggagagttaaaaactacaaaaaagaagatgaaagtagttaatctcccaattggagctactgaagatagggttatcggaacattggatatagagaaggcaataaaagaaggaattaaagcattagagccaggaattttagcagaggcaaatagaaatatcctatacattgatgaagttaatttactggatgaccatataattgatgttttgttggatgctgcagcaatgggttggaatatcattgagagagaaggagttaagataaagcatccttcaagatttatattagtagggactatgaacccagaggagggagagttgagacctcaaatcttagatagatttggtttaatggttgatgttgaaggattaaatgatgttaaagatagggtagaggttataaagagagttgaggaattcaacgaaaatccagaggcattttataagaaatttgaggaagagcagaacaaattaagagagaggataattaaagcaagagagcttttaaataaagttgagataagtgatgacctcttagaatttatatctaaagtttgtattgagttaggaattcagacaaatagagcagatataaccgttgttagaacagctaaggcgttagctgcttacaatggacgaacttatgtaactatagatgatgttaaagaggctatggagttggctctaccacatagaatgagaagaaagccatttgaacctccacaactaaataaagagaagttggagcagatgattaatgaatttaaacagcaaaataataaagataatgaagagaaagaagagcataaagatgatgacgtaaaaaaaaacatgatgaaataaagaatgagtttgaggaagaaaccagtaacgatgaaagagataataatgacaactctaataatcaaaataaccaaaatgaagatactactggagattttgaacaaacctttggcatagatgagagtgttaaggtaaatcctaagcttatacaattcaaacttaaagataatatccatagatatggttctggaaggcatattaaaagctacagcagaagagggaggtatattaaatttaaacttgctaatgataaaattatagatattgccttcgatgcaacatttagaagagcggcaatacatcaaaaaaagagaagagaaaaagccaacaaaaaattagccatctacttagaaaaagaggatattgttgagaaagttagacagaggaagatatcctcccatatattatttgttgttgatgcaagtggctcaatgggagcaatgagaagaatggaagctgctaagggggctataatctctctacttttagatgcatatcaaaagaggaataaaattggaatgattgcatttagaaaggataaagctgagttaatcttgccattcacatcttcagtagagttgggagagaaactattaaaagatttaccaactggaggaaaaacacctttagctgatgcctttattaagagttatgaggtctttgatagagagattagaaaaaatccaaatattatcccaataatgattgtaattagcgatttcaaaccaaatgtagctgttaaggaggattatgttaaagaggtttttgatgcatgtgagaagatagctgaaaagggcattaacgttatattaattgatacagaaccacaatcatttataaagattgggattggaaaggagatcgctaatagatttggatttaagtattacaaaatagaagagttaagcaaagataaaatcttagatatttgtaagagtttagaaattaacttctaatgtagcatgcctcttttgattttttatatcaatacccttacacttttttattatcatggattttaaaattcttcaacatcatcatcaacaattttaatttttaatctctttttatcctttatttttaatggttttaatggctttaaaacaccatcctcataaataacctcaataatctctgacatttaaaccaccaaaaatttcatttatggaaatcttttataaatttgttttctatgtagaactctataaaacacaatttttccattttcatatttaaaaccaattctataatctccaactctaattcgataataactatctgcaccttttagcttttttacattgggaatttcaggtggattatttttatttggaatctcttcaaaaactaattttttaatcttttcttgaatatttttaggtaactcctttaaatctttaataaaagatttttttaaaagatacttccattgtttcactgctctaacaactttttagcagtttctaaatcaatttcttcctcattctcaacttcctccatagcctttaaaagcccataatccaataacaactcttcaattttcttaaatgtcttataatctaaaataactcctttgatatttcctttttcatcagtaatataagattgaacgatgctcatttaaaatcgcccaaattactttttgtaacttttaagatataaaaagttttatagtttttcctcaatcattccctctatttctaaatacttcttccttaacttctctttcatctcctcatctgccttccacattcctctctctattgcctccaacaacctttcagttatatttagcagagcataaggattattttctttaaaaaactcttccatatctttatcaaacacatacttctcagcaatcttctcatacatccaatcgtctattatgccagaggttgcatcccatgcaaacatatgatcaacatactttgaaaagtcagcggctcctttatatccatgcctcttcattccctcaatccactttggattcatgatttttgttctgaatatttcttttccttcttcttttagatgttttgttcttatatcatttggatttgatgtatctccaacataactcactggctttttgccagagtaataggttacagaggcaattaaaccaccatgatagctgttgaagtcatccccctcaaatatatcccattcttggctatcttcatttttaactgttaattcaatctttgatagacgatttataaactcttcttttgcctctactccataatagccctttccataagcatagcctccccattcaacataaacctttgcaaagtcctctattgattcccagtttttctcatctattaaatgagagacaccagctccataacaacccggtttatcactgaatatcctatataatgaggtttctttggctgttttttcatcaatacccttctttatcttctcttcaacctcctccctataatgcttctttacatagttcatctcgtctggctcatctaaattagcaaccatttttattgcttcatctataagctcaacaacgtttggaaaagtgtctctaaacaacccagagattctcaaagttacatcgatccttggtctccctaactcttccaatgggataacttctaaaccaacaactcttcccatcttattccaaactggcttaactcccaataaatataaaatctctccaatatcatctccttttgttctcatagttggagatccccagacgataacgcctatatattcaggatatttcccttcttcttttagatacttgttaattaagtcctcagccaattttttacccatctcatatgcagattttgttggaatctcttgcggattacatgaataaaagttccttccagttggaaggcagtttatatctttcgtaggagctcctgcaactcttggagggatgtaaaaaccctctaaggcatttactgcatttataatctcttcatcaactttcattagatttttatagattgtcgagacggtttttaagacatcccttaatttagagtttattttaactgtttttagctcatcaatcttattttcatcgaagttgtattgcatatactcttttagtagatttaatcctatttcatttatttcatctaagattttgtgatactttcctttattttcatttaactcttcccaactgtaatctaaaatctctgccaaaatctccaaatagttgaattgatacctaataatcatgaataacatattaactaacttatctccttccaatgggactcccattatatgcaatccatcatttatctgcctattctttaaagtttctaagtaatcgtggattttatttaggagtttttcaaaattctcatcatttatctcttcatctataacttttccatccaacaaatcttcatctaattttagctctttaatcttctttaaaatctctttctttaaaaattcttttttctctttattctctgtttcataatagtcatcaatactcttttctaactctactaaatcaccatacaaatcagatattgtcattggtgggattaaatggcttataattgttgcataactcctcctctttgcttgagttccttctccaggattatttacaataaatggataaatatttggcaattccatgcagatgtctggatagcattcattagataagccaacacacttcccaggaagccattctaagtttccatgctttcctatatgcataattgcatctgctttgaaaacatccttaatccatttataaaatgctatatagtaatgagttggtggcaaatctggagagtggtatatggcagagggattctctccaaatcctcttggtggctgaactgagataaagacatttccattaattattcctgggattattagctctccatcgaagttcataacatctccaggaatggctccccaattttttattagctcttgcttaaccttttcagacagagagttaaaccacttctcgtaatcttctttttttacttttccaactgctttttttatcatctcttcagttagaaatctcttatcatttgtggcatagtttaacatcttttttattaactcagttccattctttggaatctcatcaactataaatcctcttttcttcatctccttcaaaatattaacaacactctctgggctatctaaaccaaaggcacttgctatcttgtcattccttggtggataattgtggaaaattatggctatttttttatctttatttgactttaattttaaatttgcatatcttagggctaaatcaactatcttctcagctctatctcttatagctctatacttaataattggaactccaacttctccatcttttatcttctccttcccaccaattgggaaatgtattattgccccatcaaactctggcattgccattcctataattaaatcaattggatttaatccagatactgactttttccaatcctcaataaatccagttgatataatcccctgcagtattggaacattaagctctttcaaaaactccggctcatcttttaacaactctgccttaacacccattgaaagagtgaacatggtagtgttaattaaggcatgaactattggcttcccatctttgtagaaaaatcttttgaatgtttctaaagttcctatagagccgagttcgttctttaaatgagagctaaaaacagctattggaatagctcctttattctcaataatatcaatcaaatcattaacataatcaatgttattagctacaaaccaatttctataaaataaaactcctataattggtttatctaaatctctgcccaattcttttagatagtttagataatcatctaatgtttcaaagtattttcctttatagtaaattccttgccatggcattggtcttggttcttcatactcaacatttaaatttccaaacctatttgccaaatataaaagaagatttttgtaattataaaccccttcatatcccaaatatttgacaactttattctttacgtcatcatctactgtcctatccttctctaaatctggatgaatttctgagattgttggtagagggagaaatgggatgttatgccttttacaaaactcagccaattcatcgtaatacttgaaggcatttttccctcccatgagttttgtaaaaacaatattagcttctttaataaactctaaaaattcttcaaactcctttctgctacatttataatccaatattttaaattcaatgccatattttttaatctctttatatgcttcttcaaaaactaaatcatcactatctattgttgaaacaaagccaatctttatcataagtatcaccaattatattaaataaaatcttaattaacttaacaatatctttagtttattatttaatttatcatctttttatcactttttataataaaaatttggtggatggtatgaaacatttaatattaaaggtaacaaacagatgcaatctaaattgtatttactgctatgcaaacaacaaaaataataaagatatggattttaaaacagctaaaaatgctatagattatttactaaacttagataatcagataaaaatacaattcacaggtggagaaccacttttaaattttaatttaattgaaaagattgttgattactgtaatgataattatagcaactgcaatattcaatatgccatacaaactaatgcaacccttataaacgaaaaaatagctgaaaaaattaaagaacttgacataaaagttggtattagcatagatggattggaaataaatgatatcctaagaccttataaaaatggaaagccatcaacattagatactttaaagggtatgtatatcttaaaatcttataatatcccttttggaataacaactgttgttacaaataaaaatcttccttatttagaagaatttgttaaatatctaattgcctttggtgtaaagagcataagttttgatttattgaaaccaaagaaaaaagaacatttaacattaatgccaaatattgaagaatttaataaattgttaaataaattgggaagatatcccatctacataaagaatctacaaaaaaggccaaaagataaatattgctatttaaactctggggatttactatttgttaatgaatttggggatatttatttatgccctacattggaaggactttcctgtttaggaaatataaacgataaaaataaaataaaattaccaaaggtaaaaagtaaaggatgttatgcgagagagttcttgataaaaacatttaaaaaataatgaagttatttaaatcttttcaataactaaaattccatttcctaagctttcaattttgaaatcatatcctaatgattcaagaatatcgactatatccttttctgaataataccccctaaaccttttattcaacctattatagaactcaaatacttctttgcagatattttcattcttatccagtataaattcttctgaaatgaatatttttcccccactatgtatagaagacatcatcttatttagaaactgctttaatgatggagcatatatcattgtatgtgagcatataatataatcatacttttctttaggaattattttagtaaaatctatatttttaagttcataggagtcacaatacaatcttttaatcctacattctgcaatctgtaaaagtcccttagatatatccactcccatgtaatgtccttctggatatatcatatctataaagtattttggagaccttgaaccacaaccaacatctaatatataatctcctttatcaatctttagatagtcactggcaatctctctgcataatgaatagtatggactacttaatatcatatcccagatgtcagggtctttcttaaagcttatagcaatctttggatggctataacttattagagcgtatcttgatacatgcgttataaagttatatttcatcacataatcactaataatcttatcaaattttggcatttttatatttagttcaaaatcttcgtttatcttaattttttcatcttcatattttaaaatttccaatttcaaagctgtttttatatagtcaaggataaactgcttatttggatatttcaccaataatggaatatcatctatttttggtgaatatttagcaataattgggaaaatcccaaactcaacaccatgctttataaatgtaacgagcaattcataacttaaatactctatagtgttatcaatcatttctattttcttttttagttttatttcagatggcattatatcgtttataacttcactaataatctcatccaatatttttgagtcatcatctcctatctcaaatgaccctcccccaaccacattctcaatttttgctgaatcaaatttcatattaccaccttaaagattctataaagtcactatcctggtcttttaatacctcaactattttctttccataatcggttagtttatatatttttactccccctctctccacacattcaactaatcctaattctataagcgagaaatggccgttataccttccattcataccttttagacatccaagcacattacttgggtctgaccttacccttctcgagatttcagatagataaatgccatgaggatacattttatacagcaaatacaatatcttctttcttaatttacttttatttagcgacctaataatcattgggtcaataaacgccaagctcatattactccctcccccactgtagtattattttataaaaacttttttagtgttgtagagacttgcattatactttatccgaacagactaaaaatcgtagaaacaatacttccaaaaaacccagatattttacctaatattgagttattatcagcgctttttttagtttctatgttacttttaacatttttggcagtggattcctcaatatttgatttgttatctttattattggagagatttttaatatctattgtcatgtttttgtgggtttctgatgtttcatttattatttcatcactctccttgttggatttctgttgcatcacccctttacttccatttatttctatagatattgatttttttaagattaccggaactttttgataattaaagagtgcaaagttattaaccctcacatatagagttatattataaatcccactctctaaatcccccaacgtcaaaggaactatcaattccttctcagattttggataaatctctgtttggaaaatggagcttttatagtagatatttgaacctctactaacatcaacccaatactgaactgttaaattcactgggaacttatcatttttaatttttgcttttaatacatcactactactgttgtacgctaaattctcaatattcactggggaaataacctctgtaactacatgtgttcctgtaggtattttatttcctaatacatcaactgctgaatatctcccaaccctgtaataatctgatattttaactaagtggattccataacttcggtatatataatatcaacattctctacagattttggaattatatgagctacagtatatccttcaaatccttcctcgaaaaatattggaaatgccactttagcttctgaatagttatctaatttaactgttttaataccactttttgctctaacctttccatctttgtcaataacttcaatccaaacgtcacaatcaactttagagttcaaattatttcttaatataactacacatgtgttgttaaatcctgcaataggtttggctgagtatattccactattttcctttattacatttatttttcccaataatagtgtgttattgtaatatattctaacaatacctattggagatattgcatagaaatgagcaagggatgtataatctttagcccctcccttaactgaaactgtgatttttaagtcaccatttacttccttgtaaaagattattggaacatttatctctttaatttgatgaggttctatagtaaatggaatttccttagaataatttgctattccatctttaaaattatcatctatggtaatctttcctgataacgttttattataaatattttttataaatatcgtcatattatatctttttccaattattacatatccactaatatttgtttcctcacctatttcttcatcttttggcaaaataatcttttcaataattactggtggtataggttttgggtctatgttaatactgtatgacctattaaagattaaagtatctgcatctatggggtttattgttaccactatattcttactgcctttctttgtatatattggaataaatacatccttcttctcttttttatcaatattaattatcttggtaaatattacattatcatatttaacagtcagtttggccttaacatccctatcatatttattttccacagtaatttttaaaatagccagtgttgggtcatctataacataatatcttggtaatacatcatccttctgtaaatacttatctgacaatatgtctcttatttcatcatctaatatatttgcagagtcataaaaattctttacaaactctgaagtgttttcatcaatctttctataaagttctacattctttataacaactggaaagtaataatattttgttacactcttatagtcatagtatattccagaatcatccctcctctgaatagtttcttcaacaccatcaatggtatgggtaacattcattatctctacatttgtttcaactgtaaatttctctttatcaagaacaatcttaggaactttaaaagataccgttacttcctctccaagaggaatatatactgtcttaaaatcgtttttaccattataaattatattatctccatcttttacatttatccaaactttagcaatataatcgctctttgctgtaggattactttttagagttatatcaaaccagttagaatagcaaacttcagtatttccaattttgtatgagtcctcacatgttacattcttaacatccactggaaaatacggtctcactttaactgttgttgaagctatagtttttccattttcaattaacgatattttagcatcatgttctttgtcatcactaatcggaactctaacctccacaattttttctatatgactatttggtggcaaaggtattaaaccagatccccatgtctttccattacactccactttaactataacatcatgctcatattcatccttatttacaacacccaaatatagaacttgctcactaatatctacatgcaatattggtgaatttggtgggtcatacggtgaccataccttatatacactaacatccccacaaactactggcaataacaataataaaagagccaatactatttttttcataccccctccccccaataagactattttctaagactattttaattgacactaaattcattataatttgtattttcattttttcatttttatagaactataacaataaactttgattaacaccatataaatcatttagcacaaatcaatttctacatttatcgaaacctgaatacttagttattgttaaatatggctaaatatgctccaaattacaatccaaagactgataaaaagatacctatgattttatcacctataattgatgttagcaaataagatagaaatatcggaacaacaaatggtatagcaggagttacccaaatttcttcatttttatcaaactttgaaaaatcacaatctttctcagcacttggtagtaattttaaattttcatgatttccaaggattaacctttctttttttatagcttcagaaactttcattttttcaccaagaaacatacataagacctctttttttgtctttggttttactcctctaattacatttcttaaaaatataattatcggaagtgttattgagaaaaacattgcgttaattactaccattattggaaaggaaggaagataaagataatttaatattgcccctaatggagtgtgtattggcatgttatattttggaattaaagctccaagtcccattatcagttttccatcacctcctccaacacccaataagaacataaaaaaccctaagaagaaacagactataaatccaacaatcgattgaatgacatataacatatcatgtgaaatgaatgataaatagccattatatatcaatccaaaaataaccatcgatacccaaacataatcttcaatttccctactttttaaatcgtagattgaagctattaacagccctattgccccaacaataaaatttatcattttttcccccaaattttaataattttttaatagagaggaactgaaactcctaaaacctgtgaaactattagctttgttatataagctactatagcacatatccaaagtatagcaacaaagtgtagtagggagacaaacttatgccctccatccataattttgattaatatagccgaaattatagaataaacaataagagagccaaaaataatgtattctactacatcaacattagatattggagcaatattaagaatatgaatgacagtttcaggaatacttaatgatgaatacaaatcattaatcatcttagctactcctaatgaagcaaataatgctaaagctaaacctcctccaagaccataaacaaccccaacaaattgctgtatattttgatatttagattttcttaattgcactattttacggaaattcttactaattatctcagcagctgtttttgggtcacctccaaagtatatacatcgtgaaaatatgtcagaaaatagctgtattaaataactacaagagtcaaaaccaaacaacctccaagatttatttgaatcaatacccaaagctaatcttttatataatctcttgatatcatgagttaatggtccaaaatcatggtttgagagatattctaaagaactaaccattcctcctcccttagcacttactgaatctcctaaagacctcaaaaagtcaggaaatacaaattcctttctttttactttttcttcctcttttaatgcaacaaaccctccaatagctaatggtgtaaatcccaaagctaccaatatcatataaggcatttgggaaaatggagataaccccactatatacttagcccataaaagaaatggtaaaagtattacaaccaatataacggatattattaaccattttctaagttttatatcagtttcagtaggtttctcccctgtatgccataacctatcaaatgggagtctatttcttatcacaacaacgataagtaactcaacagcaaaaaatgcaaataacgctatagtagccataaagacaaaattataaggcaataagaatggaactaaaattgaaaaagctaagaaaaatgctattgaagtcattgcactaacatataattccttatacatatcaagcgaatataacattcttttgtaaaatgcagcatagtcatccataacaatatcctgttcttttattaaaaactctttaagctcctccccactgtccaatgcataagccaatctatccaaaaaatctgcaaattcactacttggtgttctctgagctaaaaatctacaagcttcagctaatgaacgcccccacttatctgtcaaaacatacaatttttcagattcttttgctaattctccaagttcttctctttcttctgaaagtatctttaataaatcttttctatttaagtcagttatagataatgttccaaattttgtaataaaaatgtgtaacctctcatttatcttgtttttttgagaatctaaagcaatatatgggtaaccaattgcactaacaagtattataattggtaaaagtaaatatatatacaaaataatgccactaaataacataaaacccaataggattaaaacaatggaagttataagtgcgggcaatacaattcttaataaataatctctgggcttaagcccaactcttggcagtaaatcaaataccacaataaccacctcagattgggaatggaagtccctccaatcctttttcgtaaaatgcccatattatatctctaacttggtagtaatcgaaaatttctcttgcaatcatttcctctaagattcttgctcttaattctaactcattgtaaatatctcttgggtcttcatatcccgctgccttagctatcttctcctctaagacataactgttatttcttccagtaaatacatgcctgtctttatctggctcccattggaacaccgcccttgtaacgactccatctacctctttataatacccctcaatttcttcaatagaaactactcttctcaaaaccttacctctctgatagacggcaagctggaagagtgcaacgtttaagttatccataaatgttaatgggacattgattgggtctccattcaacctctgtatcatctttctaacattagctgcgtggaaagttgagagaacagggtgtccagtctgcatagcctggaaagcaactgctgcctcgacacttctaatctctccaacaataatatagttaggtcttgacctcaatgcagccctcaacaaatcaaagagtgtaactctactctcctctggccctctctctcttgtaactaactgctgccatactggatgaggtggtttaacttctggagtgtcttcacaagagaatatctttgaatttggttttataaatggtaagattgcgtttaatgttgttgttttacctgatgctgtctccccacaaataaagatactcataccatactctaaacatagccataaatatgctgcaacttcagttgagaatgtcccccagctaataagttgtgtaacactgataggaacatctgtgaatttcctaattgtaaatgatggaccctttggagagacatctgtagagtagataatgttaatccttgaaccatctggtagtgttccatcaactattgggttagcatctgaaactggcctacccattcgttctcctaaattttttaaataatctgcaagttcaatctcatcttcccatgtaatatttgtaggtaacattccaaaaattttgtgaacaacatgacaattttttggaccgataacgtgaatatcctctaagtatgggtctctaccaatgggctcaagattacctaaacctattaaatccctctttaatatgtaaaggaatttatctctctcctctggtgtgattttaattttattgtctgcaaacctaaatattctttgaaaaaacccctcctccccaactgcctcagtaacctttgtacaggcattaaataatctcgttaaaacctcttcaaactcttctacactcttaggagtttcttcataaggggcgagctctaaaattttgtttaatatcattttatactttaatttttcttcggcagtttctaatgttggttcaataacgatatattttgtctttgtttctggagttccaaatatatgaataaagattgggtctccaacgggatagataatatttggatattttagctcctttaattctcttgagagtgagaccataaagtctgggattcgcatataggttcttttaaagttctcgatgtatcttcgtaaatgcggatttcgtttcattgcttcttttaattccgcttcactcattattatcaccaaaatctacaattatgcaacagatgcaatttcaacagcgataccaatcttaggctcaactctaaacacaatatttttctgatatgacccaggagccatattgtattttaatatcttggctaagttctttaaatcccccccaaatgtaaataactcagttcttattaacattgttgctgatgttcttataatagttaaaaccgattctggcaattcttttggatttactgtgcaaattattattttctttaaagctgtaattctcttaaaaaaagccattaaatcatcaacattaacttcactggcatcgtttgcaattaatgcagatattgaatcaaatatgataacatctttttcataaaatgctcttgtttccataactttttttaaaaatccatccttttttttattatcagcaattagcggataaactggaatatataataaagctcctgataacaactttttattgattgaataattcaaagaattcatctgttttataaattctaaagttgtgagttgagtagaaacgtatgttactgagtatctattctgtaaaaatccatatgccaacctctggcataagacagatttacctgtactctcctctccctcaattattatcaagctaccatgtggaataccacccccaattcttttatccaaatcatctctacttaaatcaattcttgctaattccataatccccacctaaagaatttaggaaatataacccctaattatccttgaaatcccacattcagaaataacttttatcctatggtatccagtttcgttataatttacaacaatctcccccacatctccaggagataatatattactcccaggagatgttaactgattagtagtatttatttctacaatacttccatcaataattactgtaaatgaatcattcgtaaatataattgggtctttaccagtatttttaatgtaaagggcaatagtacctgctgaagaatttctaacaatatctcctggatcatttataatctcaaaatcttgagatagctttgtagctaatgcatcaccctttttattaatatttaaagaaatcttataggtagaggtcgttaaaatccctgctacaaatgcagcgattaacaacacagcaacgaacataactatttcagacattgcacttgatgccaaataaatcaccctaaacccaccaagtcagatttatctttaattttttaataaagaagtaaatgtgatgaagtaattaatatgaaataataataaatcatgcaggggtcgccaagtttatgttaatgaatagaaatacttattaccattatctgaaactatacatatcctactcggctgtgtccaatttactacaatcgttatactatccaatgggacgagatactttttcagtttaggataataagaaatattttcttctggcactacagtgccatcaaacagtatggtaaatttgtccggttctactacaactgaaccgttattatagatggttatatttgtttgggatgtactgcttttaacatcagtaattactaacttttcatttaatttggcatgtacatggctgtaatacgttgtataagcctcatcaacattttcataataactgtccattgtcacataaagatatgctccacatacaagcaatgcaataatcattactgttgcccctactactgaactaaatcccatagaactgttcagcccccttctttatttttcttaattcccattcaattttatctaatagttcagcagatatcttttttccatttaatctttcaatgaatagaagtgatattatatggtcagtaatatttaatttccctgacccttccactacattttcttcatcaacttttattccctttaagaattttaatagttttgctaatgctttatctcccagccatcctaacatgtagtagaaatctaatatatcagacacattttcaacgcctgctctctcacataaatactccaaccattttaatgctaatataatcgcaattgggtcctcatcaggaatgtcctctaatttagcaggtttatgaacttccaatattgttgaagctaatccatccattttaaacacctcccccacaattttttagataagcttataatcttaatagcatatttttagattgattgtaattctatagcccatttttttattctcctaatttctatctccaacatctcaagaatctcggaatctattggtcttcctgcaagcttttctatatataggagagacactatatggtcgcttggtgatagcttatcccttggtcttaattcttcctcatcaaatgttattttcatattcttagcaaatcttaatagctttaatataactctgttggatatccatccaatcttattgtaatagtctaaaatgtctggtaaatatgtcataccgcccctactaatcaaaaattccagccatttaaataccagtgtcatggaaacagcatcttcaggaatgtcattcaatctatattctttctcttcttcaataggtgtcataaagcttccccccataggtgattctttaggtagctcatatttttttaatttaacttcttttttgacttctttcttaatctcccccttagtcttagtttcttcaactttttcatgggttttttctacaggtttaggaacctcaatctctttaactttctcttcagtttcagtttttttaccagtatccatagtctcttttttcttacttacttcaatttctaccggcttttcaggtttttcttcacttttaattttaataggagcattttctatttctattttctcattagttttaattttttcaatttcttctgaagtttttgttgaaacagccattgtagtaagtttcattatagcatcaagcttctgttcaagagtttgaagctttttattgagctcttctgttttatcatcccttcttccttttgatagaacctctgtaatcctctcaacaatcttatccagctgtttttttgtaaccctcttacctcttaaattgttttttaataggatgataacaaaagatggcaattttrattttaaattatccaaatattcctcaatttcatcctctgtaagaatctcctcatcagagaacataggagggggtgatgtttcacttattgtcttttgtatcatgagtatcctccccggacattgactttataatctcctcctccaaaacctcttcaataatttcatcaagattaatatcaagttggtgcaaatagagagaaccaagaattattaaatcatttgtaagctcttcaacagtttttttaagtcttttatattctgtttctaatctctcaagtttttctaagcttgttgcagtaatttttgagaccccaataaagggatttatttgatttgatacaacttcatagagagccattatatcctgcaaattttcattaatcttattaagttcaactcttagcatttcattttcttttcttaagttgtttattgaagattctaactttggtagtttggattcaatatcattaactttcgctaacaaaccttctgtggtttccattaagtctttaactgtttgttcaagttcctcgtatttttcagtttctaatgggtcttccagtaaattttcctcctcttcaggaggtccttcatctaattttttttctttttttttaattttggaatcttattttttattgaggcgattatatcttttaaccccataaggattcaccttaaaaagtttaagtgtaaaacacttaaattaaatagaatttattgaagtgtaactacatgctcactaaatgttgatggtgctctaaactcgataattccagaagctccaaattctggaataacttctccatatattctctctcttggcataatacctccaaacacatctccaacatttatagcaattatggctttatctccaaagttcattgttggatgctcggtattgttcatagaaccatcagcatcttgtaagacaattactccaaattctgttgttggattggcaatatttggccaagattcattaaatatgtccctagttccattagtatttacataagtaatttgtcctccataaactaatgaagctttataatccccatttgatatggtaactattgtagatgataaatcaatttcatccccaacatttggggacacaagtattgcaagctttgttatattttttgtatttaccgcataaccagtaatctttaatacttgtattccactcgctacctgtcttgtactttcctcaccaaccctcgcagctttgtgctgaaggttggctgccgtgtttattataactgccgctgctactgcagcgactaatactaaagcgatgaaaatgataagcgtacctataccaattgcccctcggcgacttttaatatagtctaacaacatatttggccacctcaatctcaaaaaatatttatattatatcactaaattatataatggaatttcacaatccaaacatccaataaaaaaaattaaattaggggcttattgtaattgtattacttcttgtgtgcttaagtatgcagctggtgttgtgaattcaataactgctggagcaccaaattctggaattactgaaccagttactgttgttcttgggactaagttaagtccaactgctgaagcatttattgttaaagcaactatatctcctttgttaattactggggttgtactcttacatgaaccatcagcatcttgcaagacaattattccaaattctccaccacttaaattccatgcagcaagagaagtattagtaacttctcctccagttgttaaatctgcatatgcatttgaattatatcttaatacagctttcttttcaccgtcagtaattaatatcttagtttgatttaagtctattgctgcacttcctgcatttggagttatatagatagctaaataattgatagctttgttatcatgtattccaattacttgaagtgttgaaagcccacttgcaacttgttcggtgctttctttacctgtagccattgctttttgttggaggaatccacttgtgttaattaagactgctgctgctactgcagcgactaagaccatggctatgaagattatcaaagttcctatacccatggcccccctcttaccctttaaaaactcaaagaccttcatctcatatcacctgaaagttgttatttaagatatttaagttaattacactttttaggatgtggagtcaattttgattaggaatttattgtaactcaattacagtttgtgtatatgcagctggtgttgtaaattggataactgctggagcaccaaattctggctggaactgtcctgagacttctgatcttgtaggtattgccttattaaatactgcatttgcattaactaataaaactgcaatatctcctttgttaataacgccatttgataatgaaccatcagcatcttggataacccccacaacatatgatgagctatctgctaatgaccagtcagttattgctgatgagttaaatatatcatcagcccctaaagttgcagttgtaactgtactgtagtttaaaacatgtgattccccatcatatatcaagaacaacttagcattctttaagtcaattggagcacttcctgcatttggagttatatagatagctaatttgtcaatacctcctaaagttttgtcatagtgtcctgtaactccaatacacattaaaccacttgcaacttgttcggtgctttctttacctgtagccattgctttttgttggaggaatccacttgtgttaattaagactgctgctgctactgcagcgactaagaccatggctatgaagattatcaaagttcctatacccatggcccccctcttaccctttaaaaactcaaagaccttcatctcatatcacctgagtatattaatccctcaattgcttgtagtattttcctcccccacacaattcccccacactttcctcaatccacctcactataaactgtaattttcttaaaatatattctttttgcgtaatttattgcgtagtcaattttatcggtgtttatgtagaggtttgtgtaggtaaaacgatagtcgaatcttaaatagcaaattaacgtaatgattatgccaaataaatttaaacaaatccaaatttatataaactaatggataaacatgataaaaactgttattgacaacttatgttataattttggtgaaaacatgaaaaatgatgatgcaataaaagttttatctaatgaattgttaaaaggagcaaagatgctttctactcactgttcaaagtgtggatgtccattatttgaaaaggatggaaagatatattgccccatatgtgaaaaattgaaaaataaagagacaattgaaaaaggtgaaaatgaaaaagaaattaaaaatgaaattgagaggaaaaaatctgaaattaatgagatattggatttaaacaaggtagtaatggataaaataaactatttagtaatgaaactaaaagaagaggatgaagttagtagaatacgggagatagcagaggctatttatgtattaatcaaactcaaaaagaagattgaataataattaactactttactttattatctttatttcaaagattgaaatattaatccccttttctgaaggtatctcagaaccgttatactcaactattaagttgtaggttttttcttttccatcaattttttcaaacagttcaattaaggtagtgtttttatatacaacctctccattctctacatcaatcagttttaagttactattttctgattttattgagatatagtaatatccttgttctgggaacattatagagattggcaatttctttatatcttttgaaatttcacccacttgaaactttactaatatttttaaactatctttgtttttagatttagtgattgtattattcaaatccaaattatttagagaagaaactgtcttaacagtttgtattggatttagcgaaatatttgttgatttattttcattatttacagttattattgaaatttttgaagtatttacttgatatgatgagttattgacaatatcactattatttcctccatttaaattgttatgacttaacattacaaacagtccaaatataagaattaaaattaaaataaacgccaataccatatttttaattatttttggttcaatatgcggagatgtttcctctttcttttttgataatatgggagtacatcctcttacttttaattttggctttcctactttaacaagttcatcatttattggtttttcatcaaaagatgcaacaaaaagaggagtattatcttttaaatttaaatcagtttttagctcttcctttattttatcgatattttctctattggatattatactatttattaactgtataatcctatatttaaatggttcagcaattagtttgttattctcatttttaaatttaaacacctttccatcgagtttgttactgcaagcgacaacacttttcggattttctattacttcgctgaattttatgaatttcttccaatcttttagattgtagtttttatttaaatcaaatgggcaatataagtaataatctttatcaacaacaaatactggtgaatttcctaaagaaaatagcattaatttaccatttctatatacgcctccagcaatagatacatttaaatcattataatcaagacctttttgtttcaaaaatttatccatattttcaagagcctcataaataccaacttctataagattttttaagttggttatgtatctgttgttataaactgcattgcaaaaaactcttgaaaatatttcagatattctaaatccacattttaatgtatttggctcatcgcatataacaaagacaagaaagtcctcatcattatccaatatatagtaggaatactcactataattattatcgagcaaataaccacttgaaacagagagggcaatcataaaccccaccacaataaatttgaaaatttaattaacttaagtttttaacaatatttatactttatttatttataatttatactttttagttggtgagagaatgattctaaaacttaatggatacggttacagctcaaactcttacttaataattggaaagaaaaatattctcatagacccaggaacttctgggacatttaatatattaatggaggaattagaaaggaatggaataaaagatattgacttaataataaacacacattgccactttgaccacacatcagcagattatttaattgaggaatattttaactgtccaactataatagaagataaagaagttaagcatttaaaaaatggagatgaagttactgtatcatccctatttggagctaagttaaatcctccaaaagaaataatccccttatctgaaattgaagaggagttaaaaagttatggtttagagattataagaactcctggacatacctatggttctatctcaataatctatgaaaatagtttaataactggagacacaatctttgcctatggagttggaagatgggacttacctactggagatgtcattcagctgagaaactccataaatttattggaaagaatagcaaatgaaaggaatatagataaattataccccggacatggagaaattggagataggatggcttttagctatgcaaaactttttatataaataaatgaattgtgggataaaaatgaaagttataatccctgtatcaccaataaactcactaaaaaccagattatcagaatttttaagtggtgaggagaggaaaaacctattattaaatatgcttaaagatattattaaagctttagatggtttagatattgttatagttagcagagatgaggaaattttggattttgctaaaaatgaattaaaggcagaaactattaaagaaaaatataaaggattaaacaatgcaataaaacaggcatttgaggaaattgaagataaagaagttatcattattccagcagacatcccattaattaagaaaaagcatattgaggatatcttaaaactttctaagaattatgatttaattatagctccatcaagaggagggggaactaacttattatatttaaaatctaaagatttaattgagataaaatacgagggctttagttttttaaaacatttagaagaggcaaaaaagagaaatttaagatattacatttacgattcctttttaatctctgttgatataaacacaccagaagatttgggagagatattcatccatggaaatgatacatatacaaaaaattatctaaaaagcttaggaattgatgtagagccaaagcattcatcagctggaagatttgtggtaaagaggagataaatatgacaagatatttaacattacacagcattgaagaagcaaaatccataataaatgagagtttaaaaaaattaaaaaatgaagttgaagaggttgatttatttaacgccattggaagagttttggctgaagatgtattttctaatatagatatcccaccttatgatagggcaaagatggatggttatgcagttaaagcagaagatacctatgaagcagatgaagacaatccagtagagttaaaggttattggttctttaaaagctggggagattaaagacttagaaataaataatggagaatgtgtagagatagctacgggagcaataattccaaaaggagctaatgccgttgttatggttgaatacactgaaagagataatgatagagttaagatatacagggcagtccccccaatggaaaacatccaattcactggttcagatataatggctggagagcttgttttaagaaaaaatactaaattaaccccaagagatattggggttttagctgctattggtaaaagcaaagttaaagtttataaaaaactaaaatttggaataatatcaactggaaatgagattataagcccaaatgagcagttagagtttggaaaaatctacgatataaattcttatacattagtatcttacataaaaactcttggctatgattttgaattctttggaatagccaaagatgataaagaagaattaaaagaaaagattaaaaaagctctaaaatgtgatataatcttattaagtgggggaacttctgcaggtgtcggggatttaactgaaacagctataaaagagcttggtgggaaaattttagttcatggaataaagataaagccaggaaaaccaactataattgggaaaattgataataagttaattgtcggattgcctggctatccgacctcatgcctaactatattcgatgtcctatttggagacgaaaagaatgttgtaaaggcaaaattcccagtgagatatatttcagcaaaggggagggtggaatatctaccagttatattagttaagcataagaatggattctcagcttatccaataactaaaggaagcggagctataacctctttatcagaggcagatgggtatataattattgatgaaaataaagagattttagagaatgaagatgtagaagttcatctatttggagatgttaaagttggattaaatattattggcagtcattgtattggtgtagatataatcttaaaagaggcaaagttattagcaaaaactataaatgttggttctttaggtggagtattatcaataaaaagaggagaggcagatattgccggaattcatttgttggatgaaaaaaccaacacctacaacatccctttcttagagaagtataaagttaaagatgctgtattagttagaggatatattagggagcaaggatttatgtttaggaaagaattaggctttaaatctatagaggagattatagaacatatttataaattagagtttataaatagaaataaaggttctggaacaagaatattgtttgataagtttttgaaagattataatataaatccaaaagagattaaaggctacaacatagaggcaaagacacattcagcagttgctacagctatagcaatgaaaaaggcagatattggtttaggcataaggacagttgcagaacaatataatttagcttttattccattggctaatgaacattatgacttcttaattagaaaggagagatttaacgatgaggatgttcaaaactttattaaagctttaaaaactgccaaattaccatttaaaaagccagataactgtggagaaattatatggggaggataaaaataaattatttaaactattgtccccaaaattaactattggggatgagtatgggaaaaataaaaattgatgctctaatagacaacacatacaaaactattgaggataaagcagttatttatctttatttaatcaactctattctaaaagatagagattttaaaccgtatttctacgttgaactacataaagagaaagttgaaaatgaagatattgagaaaataaaggaattccttttaaaaaatgacttattaaagtttgttgaaaatattgaggttgttaaaaaaataattcttagaaaggaaaaggaagtaattaaaatcatagcaactcacccacagaaagttccaaaacttaggaaaattaaagagtgtgaaatagttaaagagatttatgaacatgatattccatttgctaaaagatacctaatagataatgaaataatcccaatgacatactgggattttgaaaataaaaagccagttagcatagaaattcctaaattaaaatcagtagcttttgatatggaggtttataatagagatactgagccaaacccagagagagaccctattttaatggcaagcttttgggatgagaacggaggaaaggttataacttacaaagaatttaatcacccaaatatagaagttgttaaaaatgaaaaagaactaatcaaaaaaattattgaaactctaaaggagtatgatgtcatctacacctacaacggagataacttcgattttccttatttaaaggcaagggctaaaatatatgggatagatatcaatttaggaaaggatggagaggagctaaagataaaaagaggaggtatggagtatagaagctacattccagggagggtgcatattgatttatatccaatatcaagaagattgctaaaattaacaaaatacactttggaagatgttgtctataatttatttggaattgaaaagctaaaaatcccacatacaaagattgtagattattgggcaaataatgataaaactcttattgaatattccctgcaagatgccaaatacacatacaaaattggnaaatacttcttcccattggaagtgatgttctcaaggattgttaatcaaacaccttttgagattacaaggatgagttctggacagatggttgaatatctattgatgaagcgagcttttaaagnaaatatgattgttccaaacaaaccagatgaagaggagtatagacggagggtattaacaacctatgaggggggatatgttaaagaaccagaaaaggggatgtttgaggacatcatttcaatggatttcagatgtcatccaaaaggaacaaaggttgttgttaaaggaaaaggtatagttaatattgaagacgttaaagagggaaattacgttttaggaatagatggctggcagaaagtaaagaaggtttggaagtatgagtatgaaggcgaattaataaatgtgaatggattaaaatgcactccaaaccataaaattccactgagatataaaattaaacataaaaaaataaataaaaatgattatttagttagagatatttatgcaaaatcattattaacaaaattcaagggagaggggaagctaattttgtgtaaggactttgaaacgattggaaactacgaaaaatatattaatgatatggatgaggactttatcttaaaaagtgagcttattggtattttattggcagaagggcatttgttaaggagagatattgaatacttcgactcttcaagaggcaaaaaaagaatttctcatcaatacagagttgaaattactgtcaatgaagatgaaaaggattttattgaaaaaataaaatatatatttaaaaaactgtttaattatgagctatatgtaagaagaaaaaaaggaactaaggcaataacacttggttgtgctaaaaaagatatttatttgaagattgaagaaatcttaaaaaataaagaaaaatatcttccaaatgcgatattaaggggattctttgaaggagatggttatgtaaatacagtgagaagggcagtagttgtaaatcagggaacaaataattatgataaaattaaatttattgcctcacttcttgatagattagggataaaatacagtttctatacctattcttatgaagaaagagggaaaaaattaaaaagatacgttattgagattttctcaaaaggagatttaataaagttttctatcttaattagttttatcagtaggagaaaaaacaatctacttaatgaaattataagacaaaaaacattatacaaaattggagattatggattctatgatttagatgatgtttgtgtttctttggagagttataaaggggaagtttatgatttaacccttgaaggaagaccatactattttgcaaatggaattttaacccataactctttgtatccatcaataatcatatcctacaatataagtccagatacgttggattgtgagtgttgtaaagatgttagtgaaaaaatattgggacattggttctgtaaaaagaaagaaggattgattccaaaaaccctaagaaatttgattgaaagaaggataaatattaagaggaggatgaaaaagatggctgagattggagaaattaatgaagaatataacctcttagattatgagcagaaatcattgaagattttagctaacagcattctaccagacgaatatttaacaataattgaggaagatggtataaaagtagtaaaaattggagagtatattgatgatttaatgagaaaacataaggataaaattaaatttagtggcatcagcgaaatattggaaactaaaaatttaaaaacattctcatttgataaaataactaaaaaatgtgagataaaaaaagttaaggcattgattagacatccatattttgggaaagcttataaaataaaattgaggtcaggaagaacaataaaggtaacaagaggacatagtttatttaaatatgaaaatgggaaaattgtagaggttaaaggagatgatgtaaggtttggtgacttgatagttgtcccaaagaaacttacttgtgtggataaagaggttgttataaatattccaaagagattaattaatgctgatgaagaggaaataaaagaccttgtaatcacaaaacataaagataaagcgtttttcgttaaattgaaaaagacacttgaggatatagaaaacaacaaattaaaagttatttttgatgattgcattttgtatttaaaagaacttgggctaatagactataacatcattaaaaagataaacaaggtagatataaagatattagatgaggaaaaattcaaagcatacaaaaaatatttcgacacggttatagaacacggtaatttcaaaaaaggcagatgtaacatccaatacataaaaattaaggattatatagcaaatattcccgataaagagtttgaggattgtgagataggagcatatagtggaaaaataaatgcccttttaaaattagatgaaaagttggctaaatttttaggattctttgtaacaaggggaaggttgaaaaaacagaaattaaaaggagaaacagtttatgaaatttctgtctataagtcattaccagaatatcagaaagaaattgctgaaacatttaaggaagtgtttggggcaggttctatggtcaaagataaggttacaatggacaacaaaattgtgtatttagttctaaagtatatctttaaatgtggggataaagacaaaaaacacattcctgaagagctgtttttagcaagtgaaagtgttataaaaagctttttagacggatttttaaaggcaaagaaaaactctcacaaaggaacttcaacatttatggctaaagatgagaaatatttaaaccagttgatgatattatttaatttagtaggaattccaacgagattcacaccagttaaaaataaaggatacaaattaaccttaaatccaaagtatggaacagttaaagatttaatgcttgatgaagttaaagaaattgaagcatttgaatatagcggctatgtttatgatttaagcgttgaagataacgaaaactttttagttaataatatctacgctcataacagcgtctatggctatttagcttttccaagggcgagattttacagcagagaatgtgctgaaattgtaacttatttaggaagaaaatatatcttagagacagttaaagaggcagaaaagtttggatttaaagttttatatattgacactgatggattttatgccatttggaaagaaaaaattagcaaagaggaattaataaagaaagctatggaatttgttgaatacataaactcaaaactacctggaactatggagttggagtttgagggctactttaagagaggtatctttgttaccaaaaagagatatgcattaatcgatgagaatggaagagttacagttaaagggttggagttcgttagaagagattggtctaacattgcaaagataacacaaaggagggttttagaagctttattggttgaaggtagtatagagaaagctaaaaagataatccaagatgttattaaagatttgagagagaagaaaataaaaaaagaggacttaattatttacactcaactaacaaaagaccctaaggagtataaaaccacagccccacacgttgagatagctaaaaaattgatgagagaaggaaagaggataaaagttggggatataattggttatataatagttaaaggaacaaaatctataagtgagagagcaaaacttccagaagaggttgatatcgatgatattgatgtaaattactatatagataatcagattcttcctccagttttgagaattatggaagccgtaggagtttcaaaaaatgagttgaagaaagaaggagctcaattaacattagataagttttttaaataaatttatttgaagaaagcatctaaagttagttgctttcctttatcttctttctttttctttcccttctttttatcttttttagtttctttttcttctgtttttgatttttcttttacttcttcagcttttggtttttctactatcttttctttaacttcttcttttttctctacttcagcttttacctcttctttaatttctttaggttgtataatcagatttgactgtttttccttagctttttcttctttcttcttttctttctctaacttctctttctcttttttcttctttctttccaattttttcttttcttttaatatcttcaatatctcagaagctaacttatctccaactaaaacttttagctcatcctcctttatctcaaagtaatcaactaaatcagcagctacagaaggattttctttagctaagagtttaagcatctgcaaatcaaaccttgctctctttgaggatgtatgggttttttcaccaattttctttaatattttatttaatatctccctctctgcctttgtttttgttaataatctaaaaatcttaggataactgtaaggtgtccatttcctatacttctcatcctttgagagagcaacaccagcagtcattaacgttgtagcatacttccaaaaactatagttttgtcttctcatcactctacctaaatatcgatctgcctttgataaatattcaaaagcccttgcaacttcttctggcttttcatactcttttggaacgttttcagctatccattcaattacaacgtctggcgtttcatcaacattcattaaggcagttgtagctattccatagtgagtagtttttaaaataactcttaaagcatcgaagatatttgcctctctctttctatctggcaatttttgagctgcttcataacttaaatctccagataaagctaaagcctctaagtcatttattgcactcctcaaatctccagctgaatgttgagcaatcatctttagcgttttatcatccacatcaagcccctctttctcagctatcttttttagaactttatagactgagtttgtatgcactggatttaattgaattacctcaacataaggtagaagactccttattgatggagcgtaagcatcgtttgcagttaaaattattgggttctttgccttttttataacctttataagctcagagacccctccagcatcttcctttccagagattccatcaacctcatctaatacaattaaaaatttttttccaaagatggatgaggaagtagcagcatgccctacaaccttttttattgcagaagaatttcttttatcacttgcattgagttcaataacctcaaatccgtaatcgtttgctaatgcataagccaatgttgtttttccacatcccggagggcctacaagcaaaatcggttttggagtttccccttttaaataactttcaatccatgtttttagtttctctttaaccttttcatgcccagcaacatctttcaatgattttggcctatacttctctacccaacttaacatagattatcccttttatagctaattattttaatccaaataatagttttattaactcaactacgtttgatttgttatttgtattgcaaataaaacaataattatcaatatttttatttggttgaatttattatcaacacctcttaatatttcttcttttgtagctctaatttccccttttaatctctcttcaaccaataaaacatcctcctttgtagccaattctttttttagttcatcctttaattcatttttaataataatcttctcattcttaaatttattttcaatcttctgttcattttcttttataaattcttcaactattttatacaactcttccgccttttttcattcttaacatttttatatatcaactcatataatttagcataggcaatagccatggaaccaccttattattaagacaattagtattattattttttattaattttaaagtccaaagctaatatatattctcttggggcataactcttaactattcttttttccaaaacctcacaatcacatttcttctcaaacaattttattgctttatcaaagtcctttccaattgtgtaatagtgtataactcctccctcttctacaatatccaatgccttatctataaatttatgagcaaattttggcaaattcattataaccctattccctttaacatcaacctctctaacatcactcaatataggaattatcttatgttctaatttatttaactttatattcttttttaaaagctctattgcatgtggatttatatctatggcatagatttttttggcatttttgcaagctattgagaaaggccccactccagcaaacatatcaacaaccacatcattcaaagagacctttttcataatccttgctctctcccctcccaatcttggagagaaataaaccttcgctatatcaacccacaaacgataaccattctctttatggattgttagagttctattctctcctgctaaatgctctaactccctaactctaaactctcctttaacctcactctttcttctaaaaacccctttgcatgggattagtttgtaagccaattccccaatctcctttcttattttttcatcaacctcatctgaaatctgcaaaattaccaaatcaccaactacatcataagagagggatattaagccctcatcaatttcctttctatatttttttgatattatttctctaaaacttggttttttaattatttttttctcttcaagctctttatcaactaactcaaactcaatatttaaaatactttttaaaatatcttcatcaacatcttttattggtaaatagagataatttccctcagaagttattttataatccttgtttaataagttattctctatcaatattcttcttgtttgctcaccatgttttttgtttatttttaggcataacggcatagaatcaccaaattattataatttttataatttcttactttttaagaccctataacctccttttattgtaactgtctcaacatttccaaagacatctttcatatatttagctaatgacttagccccttgctttgtttgaataactacccaaatctcgccattatcttttaaaagttctttaccttcctcaataattctatgtaaaacttcctttccagctcttattggtggatttgttataatcttattatactttctgtctttaacattttcatataaatcgctatgaactaccctaatatcataattatctaaattatttagttttatattctctttggctaattttattgccctcctgtttatgtcagccattgtagttgatttaacttcatcagctaaggcaatgccaataacaccataaccacagcccaaatccaagatgtcgtcatctttatcaacaactacgttttcaactaaaatttttgttcctttatcaacctttccataagagaaaaccccactatctgttttaaattttaatttttttcctcttaaaatgtcttcaacaatttttacatctgatttagttgttggcttttcagagaaatagtgcattctatcaccgtgctcttatttcagtatttgttaatattttatgacaaattcttaaacagttaatttattataaaaaatacaataataaaacagttcttaaaaaacttatagcactgaaaaatataacacaaagttaataaataaaaagaattacaaaaacatcaaatattattaatagttaattgttaattcccataaatattgcccttatttatttaatttcattcaataaccacataaacgtgtaattttgcaaatatcgtctatcattacgtaagaaactacaacaatataaataatggctcatgataatataaaatagtttttaatagtataaaaggtgataaaatgcatctcttagatttggatgtgttgagtagagaagatgtactaaaaattattgaatatggaatatacttcaaaaaaaatagaagaaaacatgaaaaaatcttagaagggaagagtgtagcgattttatttgaaaaaccctcaacaagaacaagaatgagttttgatattgcagtttatgagttgggagggcatccactaataatgaaccagaatgagatacatttaggaaagaaagagtcaataaaagatactgcaaaggttatgggcagatatgttgatactatagtggcaagggtctataagcatagacatttagaggagatggctaaatattcctcagttcctgttataaatgctttaagcgatttagctcacccatgccaaatattggctgatttgatgactataaaagagtataaaggcaaattcaaaggtttaaaaatagcttatttaggagatggaaataacgtctgtaattctttaattttaggctctgctttagtaggaatggatacttatgtgggaacaccaaaaggttatgaacctaatgctaaagttgtcttaaaagctaaggagattattaataattatggagaaggttctttaacattaaccaacgacccaatagaggcagctgaagatgctgatgtattatacaccgacgtatggattagtatgggtgatgataaagacaaagaagaggttttaaaaatctttccaccattccaaattaatagcaagctcttagagtatgctaaagatgatgttatagttatgcactgcctcccagcaaatagaggatatgagataacagacgatgttattgacggagagcattcagttgtctatgatgaggctgagaataggttacatgttcagaagggagtatttaagtttatatttgagagaaagtaatctaagaggcactgccgagcgtagcgaggcagtgtatcctgttttgatgaaaccgaagcgttagcttcgggctacaaaaacttttcgggtttttgtttaacttttactaaaagtttcacagagaatagattgcacgttcagaaaggagtgtttaagtttatatttgaagaataattttaaaatattaaaaaaaggcgataagcaataaaatcagcaatatcttaatcataacacttattgtataatttattaccgccaactttaaaccaaaccttccaaataaagatatgtatgttccaatagaatgctttaaataaatcatggtaacactgataatatttccaatcaataaaactattaatgcctgtttctcatttaaaacaccattttttatcaaaatatcaactgtggtatatccagcagaaaaatgggcaagatttgctatcaaaacagttattgcctcacctggcaaatcaagaattctaaatatcgggctaaacagtcctttaacaacatccattaaaccaagttttatcaagaagtttattaatagggtaaagataacaatcattggaataactttttttaagatttttaatgattttttaaagcctttaattataacttctctattaaatacgattttttcattgttgttgttatcaatatttatctgccttcgttcaaaaaatatatttgcatacaaaattccaattaaagcctgtaaaaatccagagataacgttaagagagacatagataagtcccaacttatagcctaaaataacaacagctaatggcaattgaactctaaaaacactctctcctaaaattgtgggtaaagggctaattatagttgttactataacttctttttcattaaccttattttctttataaaaaccggataacattgactttccaacagttggatttataaaatttcctaataaagacactacacactcttctggaaggttagaaattaaacaaattggctttgttatttttttaattttgcttattagattggtttccactataatacttgcaatagtaattccaatagatgaaagaagtattattttagttaaatatggtaagatatccatactatcccaaaaaaataagaattatcctttaacactctcttttaaaagaacatcgattttttctgtaatctcatccaattcctcctctgataacggatttggaataactctattttcattttcataaattgcctttgcaatctctctgaatgtatttgctatctcactgtctggagcatattcaataactgtctttttgtaaatctctgctcttgtaataatgttgctcattgggatttttccaataacttgagttccaatttttttggcaaaatcttttacaatttctggagcatctataacactcctcccattgtaaataatcccccctaatgcaatctttcccctacttgcatacctctttatccctttacatatattgtttgccgcatagattgccattgggtcgcaggttgttacaatataaacatcatctgctaagtgtttttgtaaaggcattgcaaaaccaccacaaacaacatcccctaaaatatcataaataacaacatctggctttagttcttcaaaagcccctaatctgtttagcatatcaaccgctgtaataactcccctcccagcacatccaacccctggctcaggtcctccagactcaacacaataaactcctccaaaaccctcaaaaactatatcctccaatttcatattttctgctcccttttttctaaaaacatctaaaactgttggaatctttcttccaactaaatttcttgtcgtatctgcttttgggtcacaaccaacaactaaaaccttctttccatcttctgccaaagctgctgcaatatttgagacagttgtagattttccaattcctccctttccatagacacaaaattttctcataattattcaccaaaatttttattataaaatattatatagtgttaataaataaactgctaatattattaatgtattatttaatgatttaataactttttaattataaaagaaataaaaaagaaacaagtgttatttttattttgttatttttatttagcaatgaatggtgtcgcagtgttattttctatgttatattttaggaagaagtgtgtttttcttcctttaaatgcttctggatgcaaaatagtcgctaaatccattataacctcatcagtttttagcaatccaagttgccagtaatcatcactctcacaaaatactcttccatttttaactgctttaaatgtttcatatcctggattatcttctttaaatgttgataaccatgctgtacttgaaggaacaacccaaacatcagcatcttttgccctctcagcaaacgtctcatagttgatttttgcactgcctgttccattgaggtctttgaaaatataatctccattgcagtagaacattatttccttagcaacataagaattattttctggaacatagcatccccattgagagttgtaaccccatgcaactgtaacttttggacagtttttagttttatttataacttttaaacaattgtcctcaactttttcaaaatatctttttgcttcaggttctttgttgtaaaaggcagcaaacatcttaacccattcacacctaccaagcgggtcgttttctaaatactccgcatcagcaacataggttattcctaactctttacattttgctataatcttatctccatcatagccaggatatacaaatataacctgtgggttgatttcaataattttatcccaatttggattacttgatgaaccaacatcaattatttttccttctgctaaacttttgtttatatctttaaaataccacttataggattttccccacattattcctttaactgaccctataactgaaccatcatcatttattgcctccattaacgcaatctctgtagaactcataacaataacccttgttaaaggcacatttataactttgaagttatctcccaacttctcttttgcccaacttggaactgggtcatctttgttcttcaataaaaacttctgtcccgttgcatcaataaaaaccttatatttccacttatccccattgtagggattcacaatatttccattttcatcataatatattaggttcatatttttagcgtattttaaaatttttgtaatatttttttcagatactggcatgttagtggtgattttattggaattatttatgtttatctctttctcacttacgcatccagacattacagctgttaccattatacacaatataccaatagccaaaagctttttcataataaaacctccttaccttattaaaagaagttttataaattattcagtaatctttatttttggcatgtatataaatcttattatccaagccatattaaaaaatatattacattattacctcttactcatatacgtagtaagtaatcataataacgtaattaaatagtaaatgagtgtgttattatgaaacttaaaagatttttaaccttatcaataatcctaagtattttgttagtgatttcttcaatctatagcataaaattaggaaccatttctataaaaaataaagaattagctgattatctactaaaaggcacaactggaaacaaaataaaggataaaattatctttaagttgagattgccaagaactattggagcaattgttgctggaattgccattgcattagcagggattttaatgcagggctattttagaaacccattagcagacccctacctaatgggagttgcaagtggggcatcgttaggagttgttttatacctctttacctacatgctcttcaaattaggaattccacacaacatttatggatttataatatctgcatacattggagcatttataacgatgtttatagtaataaatattgcaagggttgttaagcaagtttcaactttgttaatttgcggtttaatgattggagcaatcgcttctggattttctactattgttatttatttgggagattatattggagaggaaaatagcaatctttcaagctttttgatgtgggaaatgggttcagtaaataatctaacatgggacatggttgttataatggctttaattaattatcccactctcaattttaacccacatctttctatcaaaaaaattggatgcaaatttgttaggggagaagtatgcaatcagtgtaggagttgatataaaatctttaaggatgtggcttattattctctcttgcgttttaactgcaacagttgtagcatttactggaccgatagcgtttgttggaataacctgcccaatacttgcacgaatgatttgtggaacttccaaacatatctatgtaattccagtaaccatgctcttaggagctgtatttttagttgttgcagacatattaacaagaccgggagttttaatatcatcaacgaatgtccttcctctactctgccctctatcaataattggggcaccaatagcaattataatctacctaaaaataagaaaaatggggatttaaatgaataaagttgggattttgttaattttatttatcctctctttaatattgccctttactgccctatatttggctggagatacccatttaataactgtaaaagacataattaatttcctattaaagggaactactggaaatgagtttaaagatataataataaaagatgttagactgcctccaataattggagcggttcttattggattaaccatatctgtagctggattaatgcttcaaactctatttaggaatttattagcctctccatacacaactggaatatcgtctggagttttaatggttgttgcactggttatatttattgattctctctcacatttatttgagatttttggagaaaagagcattttagttgctggctggtgtggaggaatattttcaatgattttgctaattattattgctttgagagttagagaggcaaatggggttataattgttgctttattgctgagttatttctttatgggtttaagagcctatttaattgcaaatgctgaagagttgaagattcaagagtattggggatttacaattggttctttatctaagataacattaggagatgtaattccaatgacaatctgctcaattatatttattattggagttatgtttttaataaaatctttaaacgccctactgtttggagagcagtatgcgaaaagttttggattggatataaaaaagacacgactgttagttttattcttcgcttcgtttataactggagctataattccttatgtaggtttaattgcgtttattggaattattgctccatacttagcaagaccattaataaaaacctctgaccatagatacttagttccagcaacaatgtttttgggagttattttgatggtttcatgtcatatcctttcattgaaatactatcttccaatccactacctctatggaataaataggcccgcctcccctcttcctattggagcagttttggatatattgggagggatgttggttgtatatttggtttataagggtgaaaagaaaataaagattgattaattttaatttttatttggataaacaatatcttttgatacttcaattggtattatgatttttggatgcattttgtttttatctaaaatatttgaatatggctcgatatagtataaacatccttttttcagttcagtatttgagtataatgacatttttttaggtaattgattccatataacctcaacaccataccaaggtttctttttatcgtgtgttacctttacacatatcggaaatgcatttaacgtgctatagattattttgagagtatctccctttatatcaatatcttcaggagcttttgcattgaaatcatgagataaattatttctaattttaacatgtttgtccaataaatcaaaaatctcgtcatcgatatttttacaatattcacaaccttcatttttaagtaaccttagagattgagcaaaatctccaaaggtaaatatttcgaaaggtttttttctgttagatattttttcttctaatatttgtttccaagtatccccccataatgccatagcattaaattcaacaataatttttaggtaattttccaacaatctataaaactccctatatgcagcatgtttaaactcatctaaaacttcttctaagaagtatatgcaattatcaaaattttcaacaagtgctggtggtaatctcaataaccaatcatttctttctattgccatttggatttttattctattttctaaatcttttgaaacatcttcggttgtaatttgtttaataatctttaattttattttttcaagtatttctttatctcttatcttgtttttccataatgaaacataagcataagttaaagagcatattttatataaattaaggctaattttttcatttcttacctctaagataacatcttctaataagaacaaatcatcttttgtaaatgactctttacttaagatttctacgcaaggttttaaatattcatagaacttatattttcttgtatttttccaatcggataatatttttaatgatatttctaagtattcatccaataattccacagactttttaaactctccttgtgaaatacttaaataaaatctacaaataagttcatcgcactccagagtatattttgaaaagattatatttgatattttcacattttttaaagattttttagctttttgtaagaaatttaaagctttttcataatttccattgagtaattcatacttaaattgataataatactctaaatattccatatatttagcgaattcgaagcttttagacctgtaataatattcttttgattttttgatataatcgattttttcttccaaatcattagcaaatcttactaaatggtcatattttaatcccaaataatagtattcctgtagtttatctcctcttttttctgaaaattctatagctttgttaatatactcctcaaatttttctttgttgtatttgttctcaatagccaaccatttgtagctatttgcatattcatcataagcaattttttcatcaatttcttttattgtgtctccagattttttataatattctgcagcttctttaaatttcctttcactctcaaatttttgagccatcaaattgtagtagaaatgtttattaaaaatttctgcttttttgtagtttttgtcattaaatttattgtatgattcctccgctaacttataacacttctctgttaattctatggctttatcgaggtttccttcgaatttcctatgttttattgatagtttcttataatagtatatttttatatcaaaatacatccaaatatctgaaaactctttatacttctctaaaaattgttcagcttcaattatatatttgtttaaaagttctaaatatttatcgttgtcttttttctctactttttctttttcttcatatatgtaggtctttaaataataataaaaacaatacatagcggatttctttatccctagttctaaaaataattcttcagcttttttataaaattccctcgctttatcaaattcattagaaaacgaatattctttcgccataatagaataataattagcaagtgtccattttttgtttttctcatccctaattttattataaatttctgatgcttttaaaaataattctgcagatttcttataatttccattctgtttttctttttttgcttctttctctaagttaacagcctgttttctaagttctctaatatttaagatattagagtccatacaaaccccctattcaaatttaaattactatatttgatattatacttcctactacatataaacttttatgaatatacctaaaaaagagatattattcaccaagctaattctaaaagttaaatctctttcaaaactgaaatatcatcttcgtaaaaaatcatcctcttttttaaattttttgcctcttcaataagctttaaatttagctcattcatctctcctatagggaaatctgtataaacaacaacatccgaattttttaattcttttaatgcctcttcaaatgtttcttttgatatctttttatatgcctcttcctcaattatcttaactcccattgcctctgctataaagtaatcagcatcatttttatgcaagatggccaacaacaacatcatatctattcttaaccaaatatctcaaaacattagccccagttcctcctccacatataacaaatatttttttattttttattggattgttctttaattcaaaataaccaataacctcactataattggcattctttaaatcatagagttcattaactatctcccttttcataacattttcaggatatccataagcaataactttatgattctttatcaaagccatcttatcagcaattcttaaagcaagttcaatatcgtgtaaagtaacaactatggctaaatttttntcatctgctaactttctcaataataaagttaattcaattttatgcttggcatctaagaatgatgttggttcatccaagattaaaacctttggttcttgagctaatgcccttgctatcattattttttgcctttctccatcactcatctcaaagaaatttttctccaacaaatattctgcattaactgcccttgccgattcgattataatctttttatccctctctgtcaatctaccaaataaatcagtatatgggtgtcttccaattgctacaacatcaaaacctgtcatgtttcctggattaaccctctctgttagaacaacagccatttcctttgctaaatcctttggctttaaatcatgaatcttttttccatttaaataaaccactcccttctttggttttaaataagttgctattgtttttaagagtgttgatttccctgctccattagggcctataatacacaaaatttctcctctgtttatttccaaatttatgccttcaactactacatagtttccatatccaacagataagttttctgttttcaacataagcatcactcaaatgatttttaaataaaataaggttttttataatttatgatatgaaatacttaataactcctaacaattaataacaataataatagtaaaatttatattagataatctttatagtcctaaatgttattaattttttttaaaaaatatgaacagagtgatattatgagaaaattattcttactatcaattttaatgattggggttatagttgcatttgcaggatgtgtggaagagagtaaaactacaactcagcttcaacaaactacccaatctgaatcacaaaaagctgaaactcagccaaaattaggagttaatgtggttagatacgcagaaacgttcaaactctatcctcactgggatgagggttattgtgtagttgctgattctgtgggtaacaagtttgttttggttgaaggaaatgctaaggctcctaacatttcagatgggaagataataaaagttcctgtaaaaagaatcgttacagacttttattgcccaattatatcagcagcagacatattgaatgcctatcatcatactatagttggggctccaaagtatgctgtagaaaagtcgccaaaacttaaagaattgtttgatgaaggaaaagtggtagatataggaagtccaagtaaaggagtaaattatgagttaatagtaaatttgactccagatattgtttttttaggtgactggaagagtgaagatgtggttgaagagaaactaaaagaattgggagtaactgtttcaagattctacacctatcaagaaccaacatacatgggaagagtagagtggataaaatttgccgcggcattctggggatccaacgcatataaaaaagcagataaatggtttgaaaatgtagttaaagtaagagaaaatatattgaaaaaggttcaaaatgtaacaaatgaaccaacggttgttatcttcagctggtcaaaaaccaaaaatatgccaggaatctatggaaatgatagttattacagcaaaatgattgctgagtttaaaggtaaaaatgtatttgatgattataatagaggctatcaatatgtagataaagaaacgttttatgaaagggctatgaacgcagatgttgttatattaatatggttctatggagatgttaagacaaaagaagatttattaaaaataaatccaaactttgctgaatttaaagcatttaaaactggaaggttctatgtgtctcatccagattattatgtttgggaggcaagagacccagctggttatatgatggactttgcaaagatgattcacccagagttgtttggaggagacgatgatttaaaatactattacaaaatcaaataaaattaattaaatcttttggtttatttttatttaaaatacattaaattaataaaagccccgctattataaagatatccaacaacaaagtgattgctgcattaaccataactattttagtccctaacttagctccaaatagagaaacatgcaaaggtaaggaatgcttaacatatcttgttgagaatgtcaaaacattcccaataatcaaaccaattaaaacctcttttgagctcaaaattccctcatttaaaaatccaccagccataactatagctgcctgcacattcataatctctgtcaatgccaaaatgccaacgttgggatttaaatttagcaagtttgttattggttgaacaaatttctcaacataatcaaaaaatccaattttagacaaatagagaaccaatgtcatcataaaaaacattattggtattaatctcttggcaaatctaatagtgcttttaaatgatttctttgcattctcctttttgtttaatttatttatctctggcatctcaaaggaataatcctctgatataattgataaatataaaaatccaattattgtctttgctaaagctacccccaaccttatcaagacatataaaactcctgtatgtcctaaaattggaacaacaactggaataaaaaatgtgaatgtatgggacaaaactgaagggaatgaatttgctaaagaagctcctataacctctctttcatttactttattctccttcaatccctctgctaaaattgagtatcctactgttgggctgaaaaagcatgctaaagtagaggatattgaaagaggattaactttaagccttcttaaaattggagataacatattacttagcttcttcatgatgccagtactcataatgtaattaacaataaacaccgttgttaaaacaataatagatattcttatggtataataagcagagattttcatactctccattaatggagttatgtaatccacaactatcacctaatattattaaaataacattcaattctcaattcaaaaaatatcaaaaaatataaatacacatttgggggaaatttatatgtgtgtaattcatgaacacattagtaagttttatatagttttattaaatagcattaaagtgtgaataaatcaatcacacatttagtggtgaaaaaatgtatgagtggaagttaaatgaaatagtcgatagtggagtatgtgcaagatgtgggacctgcactatagtatgtcctaatggtatattaacctttgatgaaagaccaaagttaatcgatgaatgtttaagaaaaggtcatggaatgtgttttgaagtatgtccaagagtttcttctgcaaagtatcagataaagattagagagaagttttatgaaaaatactattatgcaaaaagtgatattgaaggacaagatgggggagttgttacagcatttctaaaatacctattagaaaacggaaagatagatggagctatagtcgttggagatgaatgctggaaaccagtttcattggttgttcaaaatgcagaggatttattaaaaactgcaaaatcaaaatatgcaatctcaaccttagatgcattaagaaaggctggagagatgggtttagagaaagttgctgttgttggattgccttgccaaattaacggattgagaaaactgcagtatttcccataccatgctaagcacgaccttgaattaggaagaaatggaaagccagtaaaactgccaaaaatagagtatttaattggcttattctgcactgagaagtttagatacgacaacatgaaggaagttctatcaaaacatggaatagatattgaaaaagttgagaaatttgacattaagaaaggaaaactcctcgtttatgtaaatggagagaagaaggaatttgacctaaaagagtttgaaatctgctctggctgtaagatgtgtagggattttgatgcagagatggcggatgtttcagttgggtgtgttggaagtccagatggttattcaacaatcataataagaactgaaaagggagaggaaattaaaaatgctgtagaattaaaagaaggagttaatttagaagaaattgagaaattaagacagctaaaattaaagagatttaagaaagaagttgagagaaggagagaaaataatgagtatgtttcattctactggactgcagattacggaggaattggaaagagagcagatggaacatactttataagagttagagctaagccaggaggatggtataagccagaggagataaaagaaattttagatattgcagaagaatacaatgcaaagataaaagtaactgatagagctggctatgaacttcacggtattagtggatttgatgttgaagatattgttttaaggttgagagaaaaaggtcttctaacaggttcagaggggcctttagtcagagcaacattggcttgtcctggaggaggaaactgtagcagtggtttagtagatacaacagaacttgcaagaatcattgaagataacttcaaagagagacctgctccatataagtttaaaattgcaattagcggttgcccaaacggatgtgtaagaccacaagttcatgatattggaatagctggagtaaaatatccaaaggtaaatgaagaaaaatgtaacggttgcggaagatgtgctgaggtttgtaaggttgaggcaattgatattagaggagaaacatcttacacaaattacaacgtatgtgttggctgcggaaaatgtattaaaaactgtccaaatgaggcaagggaagttaaagaagagggttatttagtttatgttggtggaaaaactggaagagaggttgttgaaggagttaaaatgaagttgatgagtgttgatgaaattataaactttattgataaggtgttggttgtttatggcaaatatgctgaaaaaccacaaagagaaagattagctgcagttatgaaaagagttgggtatggaaagttcttagaagaagtaaaagagttgatgaaaaaagaaatctgctaattaattttttagatgttttatttcttttattttttaaagatatattttaaaaattaatttaaagaattaatcatgaattcccttttcggttatcctaaacattgcttcagcatctggtaagtgtggagaatcataaagcttagcaaccctcttatctccttttgcctttcttaggaatattctaaatgttgctgcatgcccaacaatatgccctccaattgcctgctctgaaggtccaaataaagcatctggtcttgcagctacttggttagttactataacaacacagttgtatatatcagctaatttgttgagagtagccatgtgccttcctaatttttgttgtctctctgctaatttacctcttcctatatactcagttctgaatgttgatgttaatgaatcaactataaccaactttatattatgcccttctcttattaaattctcaacattttcagcatacaacatttgcatatctgagttgtaggctcttgctacaaagatgttatttaaaacttcatttccatctaaacccaaagcttctgccatttggacaattctttctggtctgaatgttccttctgtgtcaatataaactgcctttggttcatttaaaatctcatcctttattgcgtcatctgctactattctctctgggcactgcaaattaacacatgcctgatgagctatctgggttttaccagaaccaaacattccagcaaattcagtaactgactgactctccaagcctcctcctaaaatctcatctaagttcttacttccagttgagagcttccatatattttttctttgggataaaacctcagttccacttttaaaccctaaattgcagagttctcttgcagcttctataatcctggctgcagctttctcactaattccatctatttctgttagctcaccgatggatgcagttgcaattttcataaaatcagtgtaaccagcttcttttaacttctcagctgttgtaggacctacaccaggtagttgagttaaatcatccattattatcaccataagcataaatttgtaattgttaatatatgaataaattgggaggtaatagatgatattgccaaagaaatatatgaaggttatcatacatcaattgtcatatttgactatataaagattttggtttataactacagtatgtttcaaaaagaagagaatttataaaaacctaagaatagtaaatatataattgaggaggtgtaagcatgatatcaaagtatttggttagagatgttatgaaaaagggagttgttgaagtaaccttagatacaaaattaagcgatgttattaaaacaatggcaaagtatgatatatcatctgtcgtagtttctgatggagagacattctggggaattataacagatacagatgtattaaaacactataatgatttagataaaacagcggaggagataatgacaacaaatccaataactgttagcccagaagctccattagaaaaagccgttgagattatggctgaaaaagggattcatcatttatatgtgaaatcaccatgtgaagataaaattgttggtgttttaagctcaaaggatatcataaagctattttctgatttgattgagtaagtttataaactctaacttgctattgctattttattttctatttcttatttggttattattaaataatgcacaacataaaatttaaatatgtggttatattatttacaagtggtgatggatatgagagtatatgttgagggctatggatgcgttttaaacaccgctgatacagaaattataaagaattctctaaaaaaacatggatttgaagtagttaataacttagaagaggcagatattgcaataataaacacatgtgttgttagattagaaacagagaatagaatgatttacagaataaacgaacttaaaaatttaggaaaggaggttgttgttgctggatgtttgccaaaggctttaaagaataaggttaaaggattcctacatatatatccaagagaagctcacaaagctggagagatattgaaaaattacgttgaaaaacactacagaatgccatatattgaagaggacatcaacaaaacactctataagaagttagattacttaaaaccatcattaattactccattgccaatatgtgaaggttgtataggaaactgcagttactgcattgtgaaaatagcaagaggtgggctaatatcttatccaagagaaaaaatcgttaataaagccaaagagttaataaataaaggagctaaatgcttgttgataactgcacaagatactgcatgctatggatttgatattggagataacttagctaacctattgaatgagctaactcaaataaagggagagtttataatgagagttggaatgatgcatgctaaaaatgctgaactaatcttagatgaacttatagaagtctatcaaaatgagaaagttggaaaatttctacatttgcctttacaaagtggagacgatgagattttaaagagaatgaagagaggttatacagtagatgaatttaaagacattgtaaatgaattcagaaggaaaattaaaaatctctgctttacaacagatataatcgttggattccccggagagacagaggagcagtttcaaaataccttagaggttttgagggagttaaagccagactatattcacggagctaaatactctcaaagaaaaggaactgaggcagcaaagatgaagcagatagatacaaaaattagaaagagaagaagtgaaattttagataaattgaggagggagttgagctatctaaataacaaaaagtatattggaaaggctatgaaagttttagttttagatgagggaaaaggttatactgacaactttaaagttgttaaatttgaaggaggggaggtaggagagtttagaaaagtgaaaattactgatgctaagacgtttggattgaaaggggagcttatcctttaatttcctttaaaacctcatctaaatcaacgtttttaacctctccaaatttaacaacctctccgtctccntcataccttggaatgatatggaaatgaacatgattaacttcttgccccgcaactctgccgttgttattgactatattgtagccatcaaatccaagcttttttagaacttcaacagtctttttaactccttttataaagttgcagagctcatcatcaggcatttcatcaaatctttcatagtgctttttaggaacaaccaaagtatgccctttatttcttggatttatatctaaaaaagctaaaacatgctcatcttcataaacaacctttgctggaatctctccattgattattttgcagaagatacacattctcccaccaaattattttttatttttttagtaataaatctctatacttaaacaataaatccgttatagctcttatatctttcccttgtatcctcgcctcatttaaatataagttatagagttgaggagttaaaggttttggcatactcttccacatttcagcgtgaatcagcaaatcaaagcatcttgcctctgcctcacttaatccaagttttctatattctccctcatgcatcttatatagcaaattctcttccttaggcatagatagaactaaatcgcacaactccgtggttggaattggctcagcaatagatacaaaaacatcatccaactcagcatctacaataaaatcttttgttaatagataatccatctccgtctctgttggatatgcaactataaaacttccagctactttaactccacaatccttagccaattttattgcatctaagttcttttccctattagttcctttcttcatatcttttaaaattttatcgctcccactctctattccataaaacacccatccaattgtatagttttttattgcctctaatatttcttcatcaacataatcaaccctcatatctggaacagataaattatttttcccaataacttcagaaaccttttccaaaagctcaaaaaacttatctctgtttatcgattttttaaaggcatataaacttccagtacctccacttattgcaattctcttagctccagcccttttaaatgctttaacctcctcaacaacatcctcaacatccctacttctaatggtttttccaaaaaactttggaacttgacaaaaagtgcaattacccaaacaacctctatgtgtctctatataaacattagctcctctaatcgactgctgttcaatatcctttggtattagtgggagaggatgattcaaatctggcttttcctttggatagtttataactatctcatctccctctttataagccaatccctctttatctccctcaataatttttggtgttgttatctcaccctctccaactataaccccatctacatttagctcatttaaaataatctctggatacgttgaaacacaacctgcaacataaactttggttttgtttttcctaactttttttataaagtctatagcctctctgatatttttatccaatatgtgcagagttgaatataggctgaaaataataacatctgactttaaaaatagtgttttatcaatctttctaactaaatgaacgttatagcccttatgttttaaaataccaccaatgagcatggcaccataagtataaacttctggactgtaaattgtaatcctcacattagccccctctttaattttattcaaaagaagttaaataaaataaccccctcatgtttttaatttctctttaaattaaattttaaaatttatttataatgaggtattttacaagtgtctaatactaacattcgaagtttctaactatatatataaccaaaaccctaccttaatgtgaggtgatactatggcagtaataaagttagatgaagtaaataaaaacttcgtaaatgaggttattgaggctggaaagttagttttaggtgaagatatcgtaaaatcaataaaagcttgttaccaatgtggaacctgcactggaagctgtccaagtggaagaagaacagcttatagaacaagaaaagttttaagaaaggttttattaggtttagatgatgttttagatagtgatgatatctggtattgtacaacttgttatacatgttatgaaagatgtccaagagatgttaaaattacagaaatcataaaaactttaagaaatattgccgctcaaaaaggaaatatggcattagcacatagaaaaacagcttcttatgttttaagatttggacatgctgttcctgcaaataaccagattgttgagttgagaggaaaactcggattgcctgcaaagtcaccaacagctcaattcagtgagaaggatttggaagaagttagaacattaattaaagagttaaaatttgataaattaatagcatttgactgggaaaagatggatttaaaggagtaaatccaataaaattagaattaaaattaaacaataaaaaattaaaggaaataataagatttttggtgataagatgaagtatgcgtttttcttaggatgtattatgccacacagatacccaggagttgagaaagctacaaaaatagttatggaagagttaggagtagaattggaatatatgccaggagcttcttgctgtccagctccaggagtctttggttcattcgaccaaaaaacatggctcacattagcagcaagaaacttatgtattgctgaagaaatgggattagatattgtaactgtctgtaacggttgttacggttcattgtttgaggcagcacacatattacatgagaataaagaggcattggactttgtaaatgaaaagttggataagattggcaagcaatacaaaggaactattaaagttagacactttgctgagttgatttataaagacattggagtagataaaataaaagagaaagttgttaagccattagatgttttaaatgttgctatccactacggttgtcacttcttaaaaccaagtgatgttaaacacttagattctccagaaagacctaaattgttagaggagattgttgcagcaactggagctaaaccagttatgtatagggattatttaatgtgctgtggagctggaggaggagttagagcgagattcttaccaactgcattagatatgacaaaagaaaaaataagaaatatgcttgaagcaggagctgattgcaccgtcaatgtctgtccattctgccacttacagtttgatagggggcaagtagagataaaagagaagtttggtgaagaatataaacttcctgttttacacttaagtcagttgttaggtttggcatttggaatgaagccagaggacttagctgttagcgtccatgcaatcccagttgacccagttttaaagaaattgggaatagaataaaccattagcattttatatttaaatattttttattattcataatttttattttatttctttttttaatatttttgataaagtcaatactaacttttttataatgtgtctatttttaatttgttattaaaatttcacaaagttatatagcaaatatttatatagtatttggtgaaattatggttaataatagaaatgagatagaagttagaaaattagaacatatatttctatgtagttattgtaatgttgaatatgaaaaaacaacattattagaagatattgaactaatacacaaaggaacctgcggaattaattttaatgatatagaaacagaaatagaattgtttggaaaaaaactatctgctccaattattgtttctggtatgactggggggcatagtaaggcaaaggagataaacaagaatatagccaaggcagttgaagaactcggcttaggtatgggtgttggctctcagagggcagctattgttaatgatgagctgatagatacctatagcattgttagagactacacaaacaatttagttataggtaacttaggagcagttaatttcattgttgatgattgggatgaggagattatagataaggcaattgaaatgatagatgccgatgctatagctatacatttcaatccattacaagagattatacagccagaaggtgatttaaactttaaaaacctatataaactcaaagaaattatttcaaattacaaaaaaagctataaaaatattccatttattgctaaacaagtaggagaaggtttttcaaaggaagatgcattaattttaaaagatattggctttgatgcaatagatgttcaaggaagtggaggcacttcatgggcaaaggttgagatttatagagttaaggaggaggaaattaaaagattggctgaaaaatttgctaattggggcattccaactgccgcttcaatatttgaagtaaaaagcgtttatgatggtatagttattggttctggaggcataagaggaggtttagatatagctaaatgtatagcaattggttgtgattgctgttcagttgctttgcctatattaaaagcaagtttaaagggctgggaagaggttgttaaagttttagagagctatataaaagagttaaaaatagcgatgtttttagttggagctgaaaatattgaagaacttaaaaaaacatcttatatagttaaaggaactttaaaagaatggatttcccagagattaaaataaaacagtattgttaatactgttatcccatttatgatttttatttttatcttagatgttaggctgtaaatttatttaaaataattaaatatttataaacattaaaattataaaaaattaaaggatgtgagagagtgaaattggaaattattgctattggaggttatgaagaagttggtagaaatatgacagcagttaatgtagatggagagattataatattggatatgggaataagattagatagagttttgattcatgaagatactgacatatcaaagcttcatagcttagagttaattgaaaagggaataattccaaacgatacagttatgaaaaatattgagggagaagttaaagcaattgtcttatctcacgggcatttagaccatattggagctgtgccaaaattagcccatagatacaacgctccaattattggaacaccttatacaattgaactggttaaaagagagatattaagtgagaaaaaatttgatgtaagaaacccattaattgttttaaacgctggagaatctatagatttaactccaaacataaccttagagtttattagaataacccatagtattccagactctgtattgccagttttacacaccccttatggttcaattgtctatggaaacgactttaaatttgacaacttcccagttgttggtgaaagaccagattatagagcaataaaaaaagttggtaaaaatggggtgttatgctttatatcagaaactacaagaataaatcacgaaggtaaaacaccacctgaaattatcgcttctggtttattgaaaaatgacttattagcagctgacaatgacaaacacggtattattgtaacaacattctcctcccatattgcaaggataaaatcaattacagatatagcagaaaaaatgggcagaactcctgttttattaggaagaagtatgatgagattctgtggaatagcccaagatattgggttggttaaattccctgaagatttaaggatttatggagacccaagttcaatagagatggctttaaagaatatagttaaagagggtaaggagaaatatctaataatagccacaggacatcagggagaggaaggggctgtattgtcaagaatggctacaaacaaaaccccatacaagtttgaaaaatatgactgtgttgtgttctcagcagacccaattccaaatccaatgaatgcagctcaaagatacatgttagaatcaagattaaagttgttgggagttagaatatttaaaggagctcatgtttcaggacatgctgcaaaagaagaccatagggacatgctaaggtggttaaatccagagcatataattccttcacatggggactttaacttaacagctgaatatacaaaattagctgaggaagaaggttatagattgggagaggatgttcatttattaagaaatgggcagtgtttgagctttgaaagaattatttaaaagaggtggaattatgctctttgataaaaatattttacaaaaaattgatgaagaattaaagacttatgtagataaagatgataaactatataacgcgtcaaaacatcttctatttgctggaggaaagagaattaggccatatttaactgtagtaacttatatgttgaagaaagacgatattgaggaggttttgccagccgctgctgcagtagagttaattcacaactacaccttaatacatgatgacattatggacaatgatgatgagaggagaggaaaaccaacagttcatgttgtctatggagagccaatggctatcttagctggagatttattatatgctaaagcttttgaagcagtttcaagaataaaagataataaaaaagctcatgaagttttaaaaatcctatcaaaagcatgtgttgaggtttgtgaagggcaggcaatggacatggaatttgaaaactactatcctacaatggaagaatacttagatatgattagaaaaaagacaggagctttattagaggcttctgtgggaattggggctgttatggctgattgtaatgaagaagaaagggaagcattaaaagagtatgcaaaaagaattggattaacttttcaaatacaggatgatgttttagatttaattggggaccagaaaaagttaggtaagccagttggaagtgatataagagaaggtaaaaagacaataattgttatccacgccctaaaaacattggatgaagataaaaagaaaagattattggaaattttaggaaataaaaatgttaaggatgaagaaattaaagaagcaattgagatattaaagccttcaattgaatatgcaaaagaacttatgaaacaaaaaactgaagaagcaaaagaatatttaaagatattcaataaagacagaaggaaagttttagaggatttggctgattttataatgagtagaatttattaaattttatttggggtgaatattatgagaattccaaggttgtatgttgaaaacgctgagaaacatgagggaagaaaggtagttattgaaaatggcggaaaagtaataaaatttttagataaagatgaagaatatgaaggagatggaaaggttttatatcaagttatatacgatgattttgataactatgtattaatgggaactgttactaaagatatgattatagagtatgaagttggtggagttagacagataacatacattaaaaaaggaactaaattattagagattcctgctgagggttataaagtctatccaattgtagattttggttgtagaattttgggtgggcatagaatagccgctttacaaagtagaaagggagatataagatttgttaataccccagttaatgggattgtgttattcttaaaagaagttccagcaaagagagagaactatgtattttatatacttccagaggaagaaattaaatttgaagaggaataaaataagaataattaacattaattaagggatactatgaacgataaaaatgtagagtttgttgctaccctaatatccatattaactgttaaagaggcattaaatagcgaaatggaaaatttcgttaaagttagagctgccattgataaaagagagctaaaggatgatgataaagttgccatctttaatataaactcaacaacaagttatcaagtattttttatagataaagacacaaatatagaggagttgaaggaagagtttaagaagatgaatgttagaattaattatgatagtgagcaggtcctaaaaagatatattgagaggttaaggattcaaaacaattctaagcccatatcaaataataacaaacaatagcaaaattatagcatagaaagaaaaatatagaaatagaatcctacaaaatacttatcatgcccaaaacaatcaaactaactaaaactattgcattgaaaagcaaaccattaacaaaaacaaaaataaaaatcatagagaatactatcgaatcttataaagaagttttatctattgctttagatttcggtttaaaaaataatagaaagagccatagaaagattagagagggaatttatgaagaaataaaatccaaactcccaaagttaccgactcattatatttatacagcctctcaagatgcatccacgagaataaaaagctttatagcaatgaaaaagagagataaagcttacacttcaaaaccaaaaattaaaaacatttccttatggttagatgacgttttaacaaactatagagattttaaaaacaatatagaaaaactatttttgatagacaaagaaggaaagaaaactttgcatttaagattatctacaccgaatggtagaatagttattcccctaaagcctcataaacagttttttaaactgctaaatgaaggctggggaataaaagctggatttaaattgagattgaataaagaagatggaacgataactgttttaattccattagagaaggagataacaattaatgatagttataaaaccgtttatgccttagattttaacttagacaatataacctatggtaatttcgaaaatatagagttaataaaaacagatttaggaaaattaaccgaaaaatactccaacataatgactaacattcaagagaaattttcttttaaaggaattcataagcaggataaaccgttgaagaggaaaggatttattttgctaaaaaattcggtaggaggttaaaaaatatcagagaagatatactaaaaaagttagccaacaaaatagccaaaaaacttaaagaaaataatgcagttttagttattgaagacttatccccttattttaaccaaaatattgctaaaaaatcatttaaaaaactaaaacataaattgcataacatctcagctaaaaaattcttaggttatttaaaaaataaatgcttagaatttggcgttaaagttattgaaggaaatccggcttacacttcgataaaatgtcctaattgtgggagtagattatctcaactgtataaattagccgatgagagggctctgccttcgaggctaatgtattgctttgattgcggattttatgctgatagggatactgtagctgtatttaatttgataaagagatttacggggctgtatccgttcagccctaagtccaatgaacccatagcagagggaacggtgtttcccgatgaagctatgggttgaggacaacccgtttccatagcttaccgattagatacgataagttattatatgataagttattaaatgctatggtaagctatggaaatggggaacggaatgaaggatgcaagaaacttagataaacagtgggttgtattatctgagttatcagctgagttggttaatagggggattaaagttcctgaaattgtttttgagaagcttagattagccaacgctctcctttcttattacattttagaccctcatgcatccataaatatattggcaaatgttgaaagagaactgaattatgttcaatcacaactctttagcttatgtgatactgaactgactgaaaaatacttagataggatgataaaagctattagaggagagattaatgctaaattcccagtgagtaaaagcaactacaatagggaagttaaaaaaagaggaaaagtagaagcaataagggtaaagttacaaaaagagatgcagattgagagattgagtgacttaggagaatggcatggggttatatttgaatacagtgatgagaaagataaagtaatcattgaaggaaatatagatagggtaaaaagagcattaaaagattttgcttttatgtggaaagaagattaatatattagttttacatgaatataagtgcattcagttaattaatgatatctaaagcatctaaattccttattaatcccaaactgcgaaaagtctcataaatattacaaaaaagaattagtccaatcttattgatttttttgcaacaaatgtacaataagggtctccaacagcttgacatttttcctctgtaacttccacaatatatgttttgttagtcatattttctaaacagccagctataaaccctgctgttagataacatatcggttccgacgctttacagtttttacactctttattatctttaactacaactgttaaaggttccgatttttcaataaccacttctccaaaatcttttttcatgaatgtaatcatatcatcataggtgttaattcctaatttaatcgcgtaatctttaccaatatcataaaaaattctttttacattatttcctaaataatatttcctcaaatattcttttatatatgcgatgagagatacaggaccttcaaaagtacagaattcttttttctcttctcccccactttcagaagtaattttaatcttatgctcttcctccctaatttctttttttaattcctctaaaggtggatatgcctccaatataagttcatgtagccgtgtcccttctgttaatttcaaaacttcttttagcaattccttattatctttgtatttttctaataaatttttcatcatagttagtttaatacccataaattttgctctgttgtcaataatcctcaacatttcaataatcttcatcgcatttgtcatttaaaccacacatacctctattctctacaatctacccacaagtaaaataaaaaaattaattaatatttacaaaaataaataccccatattttgtatatattatattttaccataattccaactacgtttaacaatgattctaaatattatagaactccacaggaataaatctttaaagggattgatacctcttaatataatctaaattccaacagttaatatatagactacgaagtcctgtattgtatatactattcaaaacttagtttgttggaagccttataaataatttttcaattttctataaaaaaagtaatattataagtcacatgtttaaaattgataatagcatttttaattcactttcaaggaaaataactatcactaattatatactattactctaaaaagaatcaaaattacaaaactataaaaagtaataaaatagaataatagagactatttattttttattttattagaccaatttcttgaatggatgtgtatctattggttcaattcctaattcttttgctgcctctgcaataattgcatcaaccatagctactgctgggaatgtcatatatgcattgtcaattgggccataaaggacaaagtctcctgacgccataacttggactaagtttgctccaacatcacaaacgtggtgaatatcttttgctttttctctttctccagcttctcttaactgttttctaaactctcttaaccagtcccatgctgatggaatgttgtgaataccactccctactggatatccaaatagtgctttaacagcaaatgatgctctaacagcagctcctgctccgttacctaatggtgtaactgctgtatcgattaaaggatacttaatacctgctttttcagcgagttctaacatccccttatctgctgttttcccaccatttgttaagacatttatctttccttcaacagttgggtccattgggtcgaaacataaaacaattgatgcttccaaatcactttcaactaaaacctgatattcttgctcatcaatagaaacgttaatagagttataaatacactgcttagcatatccagcttcagtagctctctttgcagcagccattcttgcttctcctgatgtagagtccaataacattggaccatcccaaacctcagcaacaaagtcaatataattaactaacgcctctggggttcctccaaatacctgaactaacgctgggtttccagtaatgtcttccatctctgcctgtttgttaattaaatcctctgccgctgctttgtcaaagataccttttctctcatcttcaacaattttgtgtcttgcatagaatatagtccctgctaaagctgtaggatactctcctggctgacctccaatttttctccccgcaatttcaacgaccatttgctctctgtcaaacttaaacataatttcccacctcataatttttatatatttattgttgaacaagtacttttaaactcaatatttgtatgattttgattaatgctggcagtatgtaggaaagtattatccctataactaaaccatataatattccaatatccctcccaactttttttccagccagttggaagagttcagcatttgtgttttctacctttttttctaattcatctaacctcttttttaatgcctcataatctgcagggtccattattacttgtggcaacttttcgtcttcggacatttaattcaccccaaaaaatcttatttcattaagaaatacagcgccaaaggaatacccattaacactatggctgaaactactccaattattaatccttttgttccagcagattcggttccactctctaaacctctatttctcgttattaatccaactttatattctaaatcctctacataactctgtattgatgaaacattaggtttgtttgaaacttcaacacccattttctcaccttatacaattagaacattaagattcccataattagtagcattaagaacaaaccagtggcaattccttgaatcttaccattataatatcctgcctgccactttgctaacaatccattatagcacatttcatttccaattaatctcattctactctcaattattgccatttctggtgttattggttttataacaccctcttcctcttctcctcctccttttcctccttctaactcaattataaatgggtcttcgtcaatagctcctgggtctttacttaaacactcttttattgcttgtgttattttaccaatatcttcacagtcaattaaatcaacaacttcaactatctgccttctaaatctttcaactgcttctttattcacgttctctaagaatggtatggcccctttagctccaataatacctccatcgtctccaatgccattttcccataatgctttaaaacactgtccagttatatgcccttggacttctgaaccacagagaatcataaacctaatgtttgggtttgatatatagtttgctacaaccttttcaatacccaagttttctgtgtggcaaggtcctgctatagcagcccctgcatcgatacatgcttgctccaaaccgtgagaacctaaagttacaactccaacacaactttccggatttccaacaacatattcaccagagacaattggccatcctggtgctggttctcttttatttgccatagacatcaccataaaaatttttaagagatttttagaatttcactcccaatattatcgccaacagtgccattatcccaagacctatccaaaatccaaagaatgcactcttaaagtatcctgatattgcatagacgccatctctatttgggaatgagtttaatggtggataccttggatctaaagaatgctcatatgcatctaccaatgtttccaattttttaatttgttcttctattggagaaacatcaacaaataacaaatctccaaatccttttgtaattactcctgtttcaacagtatatactaaaggaatattctggtctataaatacataagttgccatattatcaccttattcctccttcttaggaatctctggaacgtgaagaactgcacaggcatctttaaatgacatcttaacaaacttcacatagacaattgcccataatattattgaaacaattatagatactatatctaatttaactactgagaatacaaaccatgttataaaaccacaagcaactgctaatgttaatgttctcttatggctttcatttggacccaaacatgcgttaaatggatgtaatattgccatacccgcagcaataaatgccaaggccatcataccattatttaatgcataatcaatgtatttttgtggttctaaactacccacataggcaacagtaaatcctaataaagccatggctcctgcaattgataaaaatgtcatacttctaaccataattggaatcttcatacctactggatttactgttaatcttccaacgatatatccaataactgctgaaactatcaatgttataattggagctaccaaataaggaagattgaagtaatcaggaattaaaacacctgcaactgccgccaatgttcccatacctaaacttaccataccaatggacggaactcctgttccaagaccgtaagcagctactttcctaacagtatttgctccagcaacacatgctgcagatgccaataaaccgccaattaacattcccaatccataaggtgacaaaaagtttgctaaatagcatccaaccaatgataaagcaatacctacagcaaatatttgctcttcaggataaagttcagctgcatgacctcctccaccatgtgacataattaatcacccattctatattgttaaatttataaaaccatcaatactgaaattataccaaacaataatgaagctactgttgatgcaataactccattaggcattttcttgaattttgggtcgtggaatccttcaatagtccctccaatgttatatgatgctaaaaccgcattgataaagaagaaaccaactgctaacatccctgcaactcctggatctaaaccgagttttcttaaagcaatgtatgctaaagctccaccaattcctcctaaagccgctcctattaaaccactaacaaaacaaacagttggaactccatgtcctgtagtccctggagtaacataaggtttttgtggatctttagttataggatcaatttcacacttatctgcagctggaacaaccccaactccaaatacataaattaattgcccaattaacatcgttactccgagcataatcattgaacttacagctccagagatcataatcaatgccattccaataggtgataaacctacatttgatgccattactgcagcacccatcaatccagtaaaacctgcccctgctgccaactgtgttgttcctgttccaacccctgttgaggtcgccatagccgctggagcccctccaacagggataaaatgaacacttgcattaattattgcccctgcaatagtcatctcaattaatggaacaattgcgctaacaatatccatacattatcaccttttattttgtgtatggtccatacttatttcttgcaaagacctcaacctttctatttattattgccaatatagctacgattatcaaaccaataacaattgatattattgaagcagttattacacttcctccctgacctccttttaatatatctcccaaaacacctctccaaccatctaaaaatacaattaaaccaaagcataaaccagttaaaactcctcctaatcttgaacagaagtatgaggagtccataccgtttcttaaaccatattctgctttaatgtcaatatctccatggttagcaactggaactcctcctccaaatggatatttttgatattctctttcagcaccataatgaacgtctccagttgatgaaccaattgcaccaacagtaatcccaaatatcaatgcaatcaatggcagtgggaatgggtttcctaatatagtgttagctaaataagccattaaaaccatacaaaagactgcaataaaaccatgtccaacaattgggccaagatggctcattacaacatcccaataaactggctgaccaaagttctttgattgacccacaattctacctaaatatgctgaaatagcataagccccatgaacaaaagcagctactcctgctcctaaaattaacgctaaaattgggtttaatcccatttgcataatagcataagcaactgtccccgcaactgcaacatacaaaccataagaaactggctccccagatatagccttgttaaagtatctgtgtatattccccatctgtggagctaactgaacctgtgagtttgggtttgactgagaccctacatcagattccaaatcttctgcacatccagcaactgttgccaatgcaccactcaacgctaaagccccaagggctatcagtgttgcatccatcctatcacctcattttacataagacttagttttattaggttaatatataaggttttctatttgattctgttaaaattcacttaatttttatttaacttttttttagttataggaatccatccagaatattaaaaacaatgtcagaatttaagtttttgtattttacgttttaatatgcttaacaatatcaacataataaaaaattaaaaaatttagaatttagtgagctgggatgattggatctctttctccagctggctcgaattctcttaaagcacctcttgcaaactcttttcttggatgtgtgaagtcaaagactaatgatgggtctgcaaatgcaaccttaattaatgggttcaatgcaaatgcgtctcctcttgctgagtgtgcagcctgtgtaattccagcatattctccttggtgaccaacgttcattgcgtagtttggatagttaggccctctcaattctaatggggaaccttcatcgtttctgaatgataatgagttggctgctccacactggtcttgtaagtcataaccatagaatcctaatctgctgtggtattctttgtgcaatatctggcttagataccatccgttaactccagcgtttgagtttcctgtagctaatgcagttgtaatacctgctgcagcagctgtaacccctgctctttgggaacctccgaagtggtcttctaacaatgctgggaaggtgtcatactgctctaaaccatataaagttacttcagtagcaatatcttcaacaacatccattgttggttttacgctgttgcatcctccatatttcttggttatgtagtcatatccgtagtatgagaagtcatccaagatgtcatctgtataggttgctgtagcatactgtgtaaatccgactcctccagacatgtatcctcctaaccagatttggtcatacaacatagccccagcagcaacaacctctaatgactgttcaactgggtcatctgaaactcttgatgtttgaacaatatctgccaagactccgaagaagatacctcctggttcatttggccctcttgctcttcttgctggcaagaatgaagccatctgaatgacatcagcgtgctttgcagcgtatgagaagtcagcaattgctgcctccccagcacagagcttgtaagctgtaatgaatgacattccaatctgcatagcactccatcttgctattgttcccccatcacaaactctaccgactaatgttggaactcttgaaacttggtatgttctcttaccgattgccttcttgatttgttctgcctgctcttctgggaacaacttgttaatgtcaattaagaacctcttgtcaatctcatctgctaattcgtcatctccagtgaatatcttagcgtaacagtcccagactaatgctgggtggacctcaaccatgtgctcctgaacaactgctcctcctgggagagcgtggttaatagtttccatgtattcattaattgtttctggagtaacctctacccccaatctcttttcaagaacagcgtgagctgtatccatcccaacgataactgttcttcttatgtcatcccagaactgctgcattgcagcgttgttcatgaagtgtaagtcatccccttcaacaattgcatctgtatttgaaactttgtaaggcattaattttctctgccccaatggaactccaatatctgggttgtaaaatggaattcctcctctcttctcaattaatttttgtgctgcctcaacgaattctctttttcttgctgactgtctccatccgccaaagacatagaacttagtgtatttttctcttgggtcttcttcaaacttttcctttaatgcctttaagaacaatcttttttcagcatccatcgggctcacctctgtgaggaattttgatttttattttttatttttctaagttatatttttgagatttataatttatttttgtagttttagtgggagaaagttataaaggttaaatgggcaaagcccaaatcttagagtttctcgaaaacatcttctactggtaagaaccctcctaaggttcttgctctgtggattctcttaacaactgttaataattcttcatcttctctcattgggactccatcaattctgtagatggttgtaatctctttcaatttctcttctggtaaaggttctccaacatctacaggctcatctaatggtcttccaacctggtctttaacgtataaaacgtgtcctgttttctcatcataaacatatctctggagagcatcgaacattaaaccgttttcatccaatcttaatgagtgtccgtggacagtagctcctctaataccaattcttgcagggtcaaagaatgctgtatcaattaagaagttctttgataatgcttctaagtcactctctctcatctcaataacttgtcttccggataatgttccagtatctactcctctaaatctccacatgtaagttcttgctctgtcatatggctgagctggagcgaagtacattgaatcggtaaattgtatgtatctaattctgtgaccttctttagctccatttaatggctcaactaaatctcttacatagtcttctggtaaatccatctcctctaatggtgggtgaactgttttgtaatcctctcctggctgtctgtgacccattatcttaacaacatcatcatctggaatgtctctcaacttttctaactgaacatctggattcatgtggtctcttctattttgagcaatttttgtttgacctgggtagaactgtggcttgtatgccatacaatcacctcaatttaggtttaaatgaagttttatttttcttattacctcatcaattttagtttggggacaagattctcccctaattactccagttacgatatctacaactgtccctttggtcttaggttctaagggcatgacatcccttgtctttattccatatttagcaaggtcttccatatccacaggagcttgacagacaataatcgttggaatttcaacgtattttaggaggagacccgctttatagacgatatggctgataacgtttccgaaatgaacaacacagagcttatgtctatttatttgctctgcctcttctggtttgataccaaaggttgaacccagagctcctctcggagcatcatgtggtattcctgaaccagcatttaaaaccagaacgcttgtttgaatccctgcttcccttattccataagttatctcacagacaggttttgttatatgcctccttcctggtgacatcgctacaactaccacatcattttttaatgcctctgcaaatgtccctctctgtgctaatcctcccccttctcctaaacccatcactgacctacaatccacaatttgttcccttctccctactggcatactattcctctttttcttctttttctacaactgtaacagagtttgccattctacttcttggatcaaccattcctatcaatcttctgtccatctcatttattaggaagaccccatcttcaccatattttatatagtcggtaactgttggtctgtcttttaagaatttcccgactcttaagttgtagccaaatgggaacatttctttgcagatttcatctaatttatccaactcactgtcatcactgagagttatccagaatctccctgccatcactgttagctctactggaactcctttaacatgtattatcttcctctctgtgtgattcactggcaaacctcttgcaggcccataagtgataactttagggaggggctgaccgtggattacaactctctccacggtcttcaagtcataaattttattgagaaatttttcagttgtggaggctttcaaatacctatgtgggaagatttcaacttcaatcataaacaatcacttaaagttttagattttgtccttaacttctaatgctccttttatgacatacttcaatggctctctgaattcatcaattgcactgaagacagttccaactaatgctgatgttctctctggtgagaacatctgtgttccagcgtctaaacacattgcagctgcaactggcgggatagcaaatccttttgagtgtcttgtaacgatgtggtttccgttgaagatacctggccctcctcctccgtaaattgagtgactgaagaatgagaatccaactgctgtaccttctgctctaccgaagtcaactcctggtaatcctgtttcgtattctaagatgtcgttgtagtataagattgttgatgcaatgttctgtgctgctcttgcagccccacagtttactatagcagctgcaactaaaccagctgcagcgtaagcgttccacttagcaacatcaactggtttgtataacttaaatcctgatggtaatgttttgtcttctttaatgactccatcctctaaagctctttcaacaacggaagcaactactgtaccaacagttccgttcttaccgtttgctttaactaagtcaattactaagttgtctgcgtttaatccttggtatgctaaacctaataagtgtaatctttcaaataatccaacagcgtctcccatttcaaacattgctgtttgctccataattgcagcgaatgcaactgcgttcatgacatttttctttgtacatgcaacgaagtggtttgccatgatgtttcttaacgcataacctggcccttctaatgataatgggctacctaataatgcagcgatgtttgaacctttcattgtaacttcgtgtgggtagccacctaaaacagctgcatgaaccattggagcatcgaagatatcaacatcaaatgttctaataatagcttcttttaatgcttgagctgtaactaaaacagagactgaatattctgctgcaacatctaacctctttgatggaatttgaacagccatctgttttccatcgttaattaatttaattgatgtgtcgtcatcttctgaaactctaacaactttttcaacgtattcagcaattgtttcagcattttcaacaattggtaaatctaactctctacctttaatcatacaaccttttccaccaacttgaccagttctcaaagcgttctcaatacctgctaagttaactgccactgttctcttaacatctttaactaacttctgaattgttgggttgtgcaatgggctgattgcttctaaaggaacgttttcttctactaatttacctttttcatcatacaagtttattgtgtctttgtactttaccataggaatcactcccacatattggttcgatattagttatcgcagtttatatatatccagtttttcatttgaacaaaatcgtaacatttatatagtggatggatttggaatttacaggcaaagttttaaaattaaaataacataaaatccaataatttttggtgaaaaaatcccttataaaattttctatctgaaattttttattaaaaataacagttatagtgtgaaattatgaaagaagctaatctactaatagatttgagaggagaaccaggaattaactgtaatggattttgtaagttctgttattttagaaaagtcaataaaaataatccgcaaccatttggatgtagatactgtcaatttacagttggttgtgactattgtatgtactcagttagggagataaatggtgatttcattccattaccatttgcattaatggaattacaaagtagtttattatttaaaagatacagcaaagttaatttaactgctggaggagacgttagctgttatcctcaattagaggagttatgtaaagctataaacaatataggattaaagattcatcttggctatacttcaggaaaaggatttgataatgtagagattgcaaaaaatttagttgattatggtgttgatgaagtcacattttcagttttttcaacaaatccaaagcttagaaaggaatggatgaatgacaaaaatgctgaaactgcattaaaatgcctaagatatttttgtgaaaattgtgaggttcattgtgcaataattgttattccaggagttaatgatggagaagaattaaagaagacagtttctgatttagttgattggggagctaatgcagttatattgatgaggtttgcaaatagtgaagaacagggattaattttaggaaacgctcctctaattgaaggtataaagccacattcagttgaagaatttaaaaatatagttgatgaaatccataatgagtttggggattatattagagttactggaactcctttgcatgacccagttgctggaaccccatttgcattagctaaagaagaaaacagccacattttggagagattaaaagacaaaataaatggagaagctacaataattactggaaatgtagcatatccatttttaaaaaagatttttgatgaaacatctgtaaatgttgttaaagttaataaagatatcgccgatttaataacagctaaagatttagaaaaattagatttaaaagatgttaaagagactgtttttattcctccaaaggcttttgtgcatgatagggttgctgaagagattttaagaagggatggggtagataggatagttgttagaggagtggagcaattaaccttagacggagaagttagtggaatctatacaagagaagaagcattaaaatttgaaattgaagcatttgaagaattaattggtatgattaatttctttggaatgaaaaaacaataaaattatttatctaattgcttttgcaataatttagctacagcaaaacttggagttgctaaagaaacatcttttccataggtttcttttattgatattatattatactcatctaaggcatcttttaaaatctcctctcccaaaccagttataacaacatcatttaaattgtatctttttgcaatagtatcaacattctccctaattaattctaacagcttattataaagcttattggcgaaatctattagttcatcatctttaaccatttctctatcagcacataaaactctcactaaccttgttaagcaactttcaaaatcctttccagctccatctggagtgtcacaggtgtaatcctcttctgtaattttatttaatattagagatatatcagccgttatagcaaaatactctgaagatagattagttaattttcctctaaactctattttgttggctaagaagctaacaggagttcttaaagttccaacataaactaactgattattcatcaatctatctaaatctgtcttttcagctaaaacttctttatcttttattggaattatatctgtggttgtagagcccatatcaactaagatacagctatcttttataaactctgccacaaatttagctgttgcattccaatttgacgctgaaacatctaaataatttttcttagcctcttctgaagttaaaaaattcccattaacatcaaacacatatactgggcagttaaaagctttttcaactttatctattatatcctcaactccttctttttttgttttgtagcagtcagctaattcagcagtcataactaaggcaacataatcaacattatcattatagttttttaataaatcttctaattcatcctttttcttccacatagggaaatagatgtgatgaatcttataattatctccttcaatctctgtaatttttgtattagctccaccaatatctattcccaaaatcataattttcaccgtgaaaaattttataactctctaaaataattattgttaattcctaagtcaatactaaaagttgagggataagtatatgaatacttttgctgaggttcaaaaattgtatagggaatattacaacttcgcaataaaaaacaatatccttgaaatccctgaaggtattgaatatagggaatttggatatggttatttaaaaaaagttgataatagaaacctatcttttaaaaatgaaagagaatataaagattgggtgttaaaaaacgctccaatgcacttttataaatctttagcttatatgctctacccaaataaatcaggtggagcttctaaaaaaggtatatttagaagagaattagcgtttgatatagatgtccataaaacaaaaaaatgtaagcatgaagatgattggatttgcaagcattgtttagaagaggcaaaaaatcaagctatctacttaattgaagaatttttaattcctgactttggtttaaatgaagaagatttaaagattgtatttagtggaaacaggggttatcacatatatataaaaccaagagatgaaaaaattagggatattattgaaagctattcaaaagaagatagaagatttttaatggattatatattaggaaaaaatttaaacttaaattcagtaggtagtggttggagaagaagattaataaaggcaatcaaagaaagagataaaagaatatccacaaaaaaacttgaaaatgaaaaaaattggaaaaaggttattgagaatttaaagagcaaaaataaaatatataatattattgaagaaaccaaaaataaaattgaattggatgaaaaagttatggatgatgacataaggcttttgagggttataaattctctacatggctatactggctttattgttaagccattaagtggtttagatgaattaaggagatttaacccattagaagatgccatatttaaagattttgaaaataaagtgtatgaggttaatatatttgatgatagaaaattcgaaattgaaatatgtggaaagaaatacaacaataaaagtaaaaaaattactgcttcagctttactatatttatttggtcataatattaaatttgaattacttaaatcctaaggacttaacgcactatcaaatatggaatttgaatttatggaatttgaattacttggataccactaactaatattttaccagcttttgttttctttccttctttctctacaaacagccttatttttccagctctacaaaagtgttgaactctcaaaccaatatctattaaagttttgtcattaaattctctcccaacgaattcttttagtgtttcagaagttgaaccacagggagcctctctcaaaacatcaattttttcaattttattatttttaatgtataattttacttttggttttccaaaatattttagaaattcttttaagtgaggatagttatctaaataatctttataatcttttagttcatcctcatcaatatcacacattaaataggggcagaaagcgtttccaaaactctctatctgctttttaaatccctctcctttccaagccccaacaagaacaaaagctttattgttgagttcttttatctttctaacaagctcgtaggttaaatctggatttaaagtataagttataaataaatcataatcttttaatttttcaattgtattttcacttattgttatttcatcaaaatctccataatatttaacagttataaaatcacatggaaattttgatttaattgtattatatgctctgtctccataaactccatcggttaaaatagcaaccttcacactttcaccatgtatttaaattaataaatataaaatagtaaaaataaaaatggtagcccggcgcggattcgaaccgcggtcccggggtccaaagccccggatgataggccactacaccaccgggctacatcaaacgtaagcaatttaataaatactaagaaggggtatatatacttttctttctatacttcttaagtctgattttatcagatgagggcatactattcataaataaagttcccatatatatacttttcggcgtaatgtttatatataagatatagtaatttaactatgctaaggtgcctcggtagctcagcctggcggagcgcctgcttggtaagcaggaggtcgcgggttcaaaccccgcccgaggctccatttgaaactttaagaaagtttcatcaaaactaacacctcctcgcttacgctcggaggtgtaaattaatacgcaattttatttaatcacaaaacaaaagtttcattttttattttatgacattatattaataaaaccaaatatataaattgattagatttaattggattctttattttctaaactttcattattttcatcttttttctcatcttcagaaattatacctattgattttaaaatgtcttttaaaaattctatagtttttagctttccttctctacttctaacttcataaaccttcaaaggatttactgctttatatatctcctgttcagagattcctaaatccctacttcttgcttgacaaactctaacagctacatcattaatctttgaatctgcttcatcagcataatggacaatatatgcctctatagagtttggccttgttggagaatggtctccatgatgggaagcaactattttaataacctcaattggaaaatctcttttgtagagctccgcaacagctaatgttaagtggtctaaattgaacatatcgtagtggtcaaaagtgccatcttcttttcttatatagttgtatggcttcataatatcatgtaataaagctccagcgattatataatctctattaacttcaacaccgtaaacttcttccaaaacatcagccatttttagagctatttttgttactgatattgtatgttctattaacccaccttcatatctatgatgccaatttatacttgctggagcttcttcgacacttattccagtatctacaattcctggatgtgttgctttaggattttttaaaaattcaataaccttttttcttaattcttcatcctttatttgttccgccaattttattaacctctccattaaaatccctccctaaattttaaatacatctaaaagtaaaaataatatttaatctatttaaaggtgttgtataatgatagaattagctaaaaatcatctaaagaaagttttagaagtttgtggagctaacagaaattgtgaatattacccatgccactttgatggacaggtttgcttatggtgttactgccctttctatccatgtgaagatgaagaattaggagagtatgttgaaaaaaaagatggaacaaagatttggagttgtatgaagtgtttttgggttcatagggaagatgttgccactgaaatcttaagagaaattttaaatttaaccaaagataaagatatagatgaggctttaaagctcttagataaccatgagttgatgttaaaaataaaagatagggttaaagccaaatatccaaataggtgaaattgtggatttgctaaatgtagtttatattattaactttattttactccttttagcagcaataactgatattaaagaaagaattattcctcataaatacacaattgccatgattataataaacttagttgttggttattactattttggatttaatgctattattgcgtttttctctactctaatattatgtttaatattaagtattggaatgggaggaggagatgttaagctattcaccgctttagctccaatttttgcgtatccaaactcgtttgtattttatattccaaaatatattctctacttaatagcaattagtatgtttatcgccgcagtttttccgatgtataaaattttaatgagatattggaaagatattattccttcagcttgttatttaactatgatgcttggtatattatattattttataaatatctacgaaattccatacgcttcaataattatatgggcttatattgtcctatctatctttgtctcaagaaaagttccaaaatacaaagaatatacgaaaaaattaggatatttattccctgcttatttgttattcttatatattattgatacaacttattttattaaatataatgtgctattaacatccataatatacctttgtgaaataatactaatatctatcgttatttatgcactcacgggtgtagaaacttctgacaaaaaacatattgaagaattaaaagaaggagatattttgagggatgttataataatagacaaagatggtgttgaggtaaaaaacttaaatataatgaaaagaataaaatttctattagaacatgaaatcaaagaaaatgaaaaggaaataatattaaccgatggagaagggttatccaatgaagacattcgaaaaataaaaaaactctatatggagggaaaaatccctgacaaactaaatgttataaaaacctacccatttgttccgtttgttgtcattggttatgttatagttttaatgttgatgaagttagcaataatctaaagtgtgaataccatggaaaataaaataataaaatcaaaaaaagcccaggtatctcttgaattctcatttttattccttgctatattgttggcatctattataacaataagccattttctatcacagaatttcacaaaggatgataaggttataagtgatgttgaaaatgcagcaaaaactgctgtaatattggcaaattcaggatataatggaattaacccaaatgtcactttaatctatgggggaatttcatggtcagggaataagaaaaatatatacatttatatctcacctaaatcatatattactccagaaataaagaattttattgtaagctatatttataatgtcacaaaaataaaccaaagtgaatataatataaccgtaaatccataataggccatgataacaaaccatataattttgtaatattaaagttagggtgattgtatggtagatacttcaaaaattaaagcattaaaagagaaaagtagaagaacggtgaaatctggttcattaaaatttatattgataatactggttgttgtaattgttgggttattagcatttatcgcatataatgaaatcagtaacctacagtttcaagaaaaaataacgcttgaaaaccagaaaaaagcagctattgaatcaataaatcagatgtttgccaaataccctaacgacccacaaaaactaatatatataaacaaaatccaaatggcgaataatattgaagaaattaacgaagtgttggaagaagctaaaaagtacattagctttaaaaattataaaattgaggctattaaccaaataaaaagtatgtatggggaatattattctctaagtttatctgctcaggaattagtgcataaaataagcttggcacaatctactgaagagattgaaaatctattaaagtctgttgatatagaaaaagacattaggagcatcatagaaaagcagattgattatgttttagcctcaggagataaatattattatgtagaaattaatggaaaatccatgtttatgacaagagatgaaattcttaaatataaaaaattctggacattatccgaactcaaatctctaaaaataactccagtatcacaattaaataaagtagcaattgaaatatctgcaaaacagtgtggtaagttaccacataaaggagatataatttcaatatacagtaaagacggttcgttcataacatatggtatcatagattcatcctatgtaattttatcctctataagttacagtgaaagtaaatcaacatcaagtaatataaatgagcttggagaatcttactcctcatcttcctcttcaagtatatcttactcattaaataaccttccaggcatattacatgcaacagtcatagacagactcgattacgataaaataaaaaagatgtttggagaatatggaaaaaaattaaatgaaattgaagatgatactcaaatattcgatgaaaatgttaattatttcttaattatctcaattcctgatgataaaattcctgacataatacaaatagaccctaaagatatagttattgtaataaagtccaaagaataagtccagggatttgagttaagggatgtttatggattataaatatttttttataaccattatcctaatttccatattttgtggatgttacgaaaaatcatatagttttgtcgaatataacagacattatgaactaaatgaaccaaataacacaaaaaatccaaattatgaccagaatatatttttaaatcatgatttaccaaaaacttatccaaaaatgtataaatttccgaaaaattattatgaactctctgataaaatgtttcctgatgttaaaaaaagagatttagacacattaagttatattctaaaaactattaaattgccagcgtataaaaagaattattacgactgttcagaggcatcatgtcagttagaatggatattagagggatatgggttcaaaacatatttagtatatggaatattggacacctatggaaatagcggaagtcatatgtgggttgcagttcagttagataatggtaaaatggtgttagttgaaagtacatatttatgtgaaaactattactgtcccgactatgcaataatttataaaaattataatctaaataacattgttatagttagagatatgaaatatattcccaaattttatgctgatacccctgacatgtttttaattcctcacaataatagacgatttttaataacacagttggattggtggaatcatccaaaaaacgctgaaatcaaaaaagaaatgtttaatctaaaataaattttggtgattgtttatgaaatcactcataaaactgatagtatttattgtgctatgctcgttgtttttacattcaatttgtggagaaagaacaattgcagagatgagtataacatataagctaactggagaaataaccaatactaacccatattcaatatttgtcgcagtaccttcaaatataacatttgaagagaaaacattgccaaaaccagaagattttttagatgttagtacttccgttacacaaacttctggaattgttttttataaaacgatatttaatggaaaggaaggattttggattcctccatatactacagtaaagattaacatctaccactatactccaataacctatgatataaaanttgatgagtcacaagaaaattatgatgttgttggacctgctgtagttaataaagtaaatgtcattgatttaaataagctctttccagatgcaaaatatgaagggataaaaattgggaaattcaaactttatgttagtggatatattgtaaaaggaaatgacacagaatcattaagtattattgtgcctgctcctctagtcatagacaattatgatgagtttcataaatttggagatgataacgtcgatatttggatttcctcatataacgaatggtataaaaatcagatggaaagagaaaatatccatatagataacaatgacccgctaattccaaaaatggataatgatgtgttgggtgatgatacacactttaaatttaaaatattcgatgttcctgccatggctttcacaacttcatcaaatcaaccaataaggttttattacataatttattataaatataataattaacttacggggatttttatgctcaaatttagaaaaagaggtcagatatccttagaattttctttattatttttgggggttttacttgcaattgttattgccgttggatatcctggaatgtttgggtttaataaaacagttagtatctcttccatgagtttagctcatgccgctgtgtctaaaatgaagcaaaacatagaattagtatcttctgcagatgaaggcactatgaagattgtttatataaaatgtcccccaggaacttggggagctaataataatattttatatttttatcgtgatggaaatattaaatttaacataacggcaaaatgtgatattaacataattttaaacggaaataaaacagtttctacccctaaaataataattgcaaatataactaaaatagatgagacacatgtaattgttactctataccaataaaaaacaaaaatagaaaaatagaaaagaataattaaatccttggtaatttcctatcttctaactctttttgcttagctctattccagtttgaaatattttgtagatatcctgttattctactgaacttagctacatcctcagaaccacaatttatacacctatctctcaaacctcccatacttattccacatctattacaaacgcttagattttttgtgtatgtccagaaaccgatatgtgtttttgttatcttttttgttatatccatcaatacctcagggtctgcagcactctcaatattccaaatatgcattatatgcccaccgttacacaaaggatggaacttctcttcaatcctaactttctctcctaaagttataggggcatcaactctaacatgagaagaatttgtatagtagagactatccacatcatttaagtctcctctaacaacacttatggtttcttctttgtagtatttgtaatccaaccttgcaaatcttcctgctgtgttatgtaggcaaataaacccttctccaccaataaagttctcagtaccttcaactgagatatcatatacatattctggaatttcatccaatactcttattgattttattctttcaaagagtaagtcattatctatcaactgccctattttatccaacaacctaccatatttttcttcaatttctttaacattcttcattatattcaaaacttttttagctctatatctactcatgtatcccttctttaagtcttcccatatatgcagattattaacatcaataccaaatctttctttccactctctttgtgaatattgatttattatttctttaaacttctctgctatttttggaattacatcctttcctccgttgttcttaatttcaacatccaatagcttttcaatattttcttttccagtaatttttataacataacaatctctccaattttcatttacttttgattttttatctatgcttagtctatagttaattccaaggattttcaaagctaaacataaggtatcccttaatgtttcagatgttgtgtataaccttatgctataatctctttttgattcatccacatatatacttccgtctccatctatatagcctttaattaaaccttttaagaatgtttcatttgacaataatatggatggaatctctttatttgagcttagtttatttaatcccaaactctcaaatatcatggctactgttttatttagtccaattacatacaaatctttataccttctcttatcacctttaacagtaatgtaatatgcatcttttcctaatatttcttcaataatctctactaagttttcaataaactctttattggtgctcgatatttcaacacatttgtcattccaatgaccctctgacaagaatgctccaattagataaccaaatttctcatcaagttttatcttattgttaatgtaatttgcatgtccatagcttattttttcaattttctctttatcgactaaatcttcaattaaatctaatctgaaggcatttttcttctttaatactggttttaaatctttccatttagttttatattctttatagctctcctttagaatttcttcatgctcttcaatgaatttgatatggtcttttatttttacatagtatttgtctttatttttaacgatttcacttaagtaaatcttatctttacttatgcttggaataatctttggagttattataaagtctccaacctttaaatcagatgcctttacttctacaacatctaaattgtcatttatagtgaatacactatggtctccagtaactctaacttttttaccactctccaattctatctcatagatttctttacccctatgtctgatagcatgagtaattggttttaagacaatttttccatctttatcaaatgaaggagcatagatgttttcatctttaatataaacctcaatattgttatctccataagttattgctctatctttatatctgttcagatatttctcaacaaattcaccaattttaactaatttgtattcattattttcaaatatcaatatcttctcatcgtaaggtaacgaactttcagccggtgtttgtgttacagtccatcttaaaccagtctcttcctttaacttatcagcatactccctaatatattcaataaccttttcaccaaacttaactgcatcttttgactcatgtaattcttctcccaaatgatatttaagcatctcattcaatccaacaaatccaaatgtttttgttgtgttctcatacctataatatgattctccatcaaactcctgagttaggaaaggcattaagttatcaacatacaacctctcttttgtaacttcatgttttattaataatgcttctttcaaaatctctaacctttcatgcaatatctcaaataacttagtatcatctccatttgcctcataagctattctcggtaagtttagagagtaccactgcatgtttccagttcttaaagtgtctatctcagcgtctcctgtccaatttccactcaaccttgttctacaacccattgcatttgtattagttacctgccaatctggaagcatgtttataaagtaaggaatcccaaacttagcagacaattggtggattttatacataagttctttattttcatctttaaaggcattctctctcaacttaattataaagtttgggaataagaatggttttcccattgcatctccttccatcatcacatcaactaatgcctctaagattaacttcgcctcctcctcataatctccataagttcctcttgtagttccagctatcactgctggcttatcctttaaaaactctgggatttccaattctaagttaatggagctgaatattgtattgtggcataagataccagtagctgttataaagttctcattatcctcaacgctcaaatcatagacatatccattatagtcaatctctttaatctcttttatttcaaatgggatatttagcttaaatttatttatttcttctcttaaatgtggattaagttgctcaattttttctaatgtgttgagttttaattttctattatttgatttccatgcataatcgttgtatggttttttatctgttatttttcttagatgttcttttattattctatagtcataaggtaattggtcatagttagctggctttattctctcttttttgtattttggaattacataaggttttaaatcttctgtgcaatttttagcaatttcaatgacgtatagtttgtaatttcttactatttcatttcttttaatctcaatcttttccccttcctcttttattttggttattgaataaatcattcctaagtcagatagcaacaaatgtaattgtcctaatagttgttcagatgttgtatatatctgcactcttccatctttactaacatacccatctccacttattaatcctcccaagaatgctaatttcatttctttgtctccttttagtatgaactctgggctgtttttgtttattgcctttccatttatatgttcctttaagaacctatagaatcctttatttacaaatcttacagagtcctcatatcttttaactgcaatattttcatttatctgctccttcacaaatctctcaataaatttagctatgtcatcatcttttgtagttattgaaatgccgtttgtaatataacttccctcagcaacaaacaaacctaagaattgacaaagttcttttgttatttttaatttttctgggatatcattttgtctgctattatattttgaatcagttctttggtagttagtttctatataatctccaattctatactcaacatcatacggattgttaaagtttctgataatatgcttcatttgtcgtggcttaacacagactaaattaccgttttcatcatagttaaataatgaatggtcttctgttactattatagaagtcccatccttaccaataactttataaaccttccctcttggtttgtgtcttgatatcgcataaactctcttaaactctgcctttccagtcttaacattaactgatattgtataaacttcagcaatgccatccaagtagaggatttccgtgtctccatctactattattttatctttatatttctccataaattcatcaatcgcttctccaattttgcaaacttttaatttatctccctcttttatgaagattaattcatctctacctaagctctgtcctcctcttgctacgtacatttgatttagttcataaataaacatctgcattaactgctttattttttcatagctaagccctctaacataaggagctaaccaaacattaaactcatctatactttgtcctccactcatatttgtctgggcggccatcataaccttagccgcatgctgtatagctacttcaggatgctttgcaggttttgaaacagaagtatgcaatccagttccatcaacttttaaaccatatttaaagaatggtcttaaatcatgttgcaaacaaacaggtcttgttgctgcatattccaaatcgtgtaagtgtatatccccttttatatgagcatcagctatgtgttttgggaagatggctaataaagcatattgcttcattgtttcatcagcaacccatttatggattgattctgggttatacattaagttggcattctctcttgaaccactctttatcaatttggttatatcatagactggcattcctaatcttgtgtgcttatgtcttagttcttcaaatccatactctattaacttgtaattgactatttccctaatcatcggtgctgttaagtatttgactttaagtttttttagttctctctcaacctcatcagctatctttctagctgtttcttcatctgcccctgtctctctaatcaatgcttttgcaatcttttctttgtcaaatgactcaaactctttttcagatgttctaaccttcaatataatcccatttctataattctcagctacatccttatcaatcttctttaaaacattataaacaatgtcttttaactcatcggttgttattccattataaactttagcacaaacttcggatattattgtgtctaaatcgccataatttaccccactgtttattaaagatttagctaatttatttacattgaatttctcctttcttttgtctctctttattacatagaattccataactttctctgcaaaatctttagcacttatcatttaatcacccaaaaaatagtaaaaaataaaattatttgtagattttaatggatgactttattacttatcttaggaatgtgtatttagtttttcagtaataacatataaacctaacggaatggatttccgcttaaatattttaaataagtgcgataatcttttaaaatagtatataaatggaagaatccctttatttaactaaagagcaatttatattgatttattatgttgaaatattgataaggattaatttatatttttatctccttaactgctccccaataatctcatcaactctctttaaaaattcttgcactttatcttttgaaactactgctccagaggcaacatcatgcccccctccattaccaccaaactccttagcaacagccatagcaacacttaaatttaaacctctatttactaaatccctattccctcttgcagagaatttagctatatctccctcaatgtggtaaccaataactggcttatcatcaaccaatatagaggcaataatcccaatcatccccttcttaccctcaaagtaatagatgttgtttaatttttttagtttaacacttttaagttcattgattaagttctttttatactcccataggatttgattacctatctttatgcattcatcatcttctaagcagattccaatacctacagcaaataagccatttctaccaacggcatttagcatttctgacaacaaaaaggcatctctaaccttatgctcaattaaatatctatcaatcagtaagttctcaatctttgggtatttgaagattatagctgataagagttttttcttgtctgtgtcatccaattgttttttatttgggtctataccaatatcttttaaaaacttaaatgcctttccttcagaggctaaatctgggatatatggttttgtgcaataagcaattgctttgtatatttcaacatcgtagatattatagacaatatcgttcattatcttaacgtatctatactcccttgcctcatttacaataaatttatttaaacctaagagagggttgtattgcatatctccaataattcctactattgccaagacactcaaatcatagtagccaaattctcttgccactaaataacaaactccacttgcagttatctcccttgatccatctaccccaaagatgtgtgggtttagctggatgatgttttcgttgataaagctatcttttataactggaggatgatggtctaatataattgcattaaagttgtgttttattatttcctctatttgcccactacccatgtctgcaaatataaaaagtggtttatttacctcattttccttagctaatttttcaataacctcttttgataggtgttcaacaacagttaaatggaataatttgtttgttctcattaacattttagctaagattcctccactactcaatccatctgtatcgtgatgggttatgactctaatatatccataatggtttaaaatcttctctttaatagctttagtcactttttctatttctttaagtttttccatcataatcttccccctatttctttatctttaactttttattaagatggaataatatatttaataatttctaaaattgatttctaaaattacttaacggtggtatttttgaaaaaactaattaaattaaaaaataaccttaaagaaaaatttaaaaataaaaaaattattattgcctattctggtgggattgatagcttacttctatctatattattgtcagaaattactgaaactctatgtatttttataaaaaccccctacatctcagaatggtctttaaataatgcaattataaatgcaaaaaagtataacttaaatttaaaagttattaaaattgataaaattattaaaaatgtcccagagagatgttatttgtgcaaaaaaatgttttttgaaatcttaactaaagagaaggaaaaatataattacgatgttgttgttgatggaactaactatgatgatttatttgaagatagacccggtttaagagctaaagaagaatttaatataggctctccatttgcagattttaagattggtaaaaaagatatcttagagatagctaaagagctaaatataaatatccctccaaaagaaacgtgtctattaacaagatttgagtttaatagggaaatttcaatagaagatttaaaaaagatagaagaattagaagaatttttaagaaattatgtaaaaggagctataagagttagagattataaaaatttggctgttattgaaattgaagatgatttaagtaagataattaatgaaaaagaagaaattattaaaaaatttaaggattatggatttaaaaaagtatgcataaatttagagatatacaggagttattgatgaatcttatatctcaatatagcggctattcccttaaatgcatttaaaatcatagccccttcttctgtttctgatgaaactgttacaagtttagccccgctctgctcacatagttctgagaggtattcaatatagtctttttcctcaacgatacttaaagctcctccacattttgggcattgggcatttttaagctcttcttccaatttaataagctcaagcttattgacagttttttcctctaagtaatcgcaattgttacatgctatctttaccttatatttctccaattcttcagaaacaattaaagtatcaacagctcccatcattaaagcctctaaaacctctttctctccatagcaagctaatcctccatcctctttaattaattcctttaaaaatctctgaacagcttctctctctttcatcaactcaacatcctttaataatggagctgctttctctaagagctctcttataccaaactcctctgtatagcataaatcaaatgtatccaatacaatctttttaagttcatggtgtaagtaatctccttcaacaaactcattctttgtatgtcctggccctccaactaagattcctctaagttttttctcttgcaataatggaaggaattgctcatttgccttctgcccaactctctgcaagaactcatgagcggctaaatctataagcctttctaatcttcttgctgactgccctcctgctttaaactttccaggaactccacttgttagtttttttaagatatttatgtttctacctttaactaacgctattgtagcttcgtttctatcaaccaatataactccatacgcatctttatcctctaagaattcctctaacggctctaaataaaattctgaatcacatctatagatgtatgtttttattggttctggtggctctataacgtaggtttccatcttttctgttccaggcccacttcttggaaccattccagcgaatataacaactcctttctctaatggctcttttaataactttaatctctgcaaaattgcctctattgctgattgaacatttttccttgtgcttttacttttaatgtttgatgcctgtgacatctcctcccttaaatgctgagctacatcagatatccttctacctgctggaatataaaggctgataagctcagtccccttacctttcttagattttaattctttcaacatctttttaaataaatataattgttttgaatcagttgatgccataactatcaccatgagacttttattttaaatttatttttggtatctaatttttaaaatcgtaaaaatgattagtgtgtttttaaaatgagacatgaatattgagtgtaaaatattattaaaaaaagatttatatataattttgctaagctgatttatcctttttaataaagtttctaacaacatccaatatattttctgagataacatattttgcattatcttttaacacattattagccacttccaaagccttatacaattgagcttcatctttaaagtattgtcttgctgcctctgctactatttgtattgcctttgcctgcccttcagcttcaatcctcaaactctcagcaataccctctgcccttaaaattctactctggcttctctccctctgcctctaatattgctgctctcttcaatctctctgccttcatttgttgagccatggcatttttaatgtcctctggtgggtctatttctttaacttcaaccttttcaatcctaactccccatgcatctgtctctctatccaaaatttccaataactttgagtttatatactcccttttatttaaaacctcatctaactccatactaccaattattgccctcaatgtggtttgagctaagtttattatagcatattcgtaatcctcaacttctaaaattgccttttcaacatctataaccctataataaacaaccgcatccacttttacaactgcattatcctttgtaatcatctcttgaggagggatatcggtaactctcgtcctcatatcaaccttaacaggcacatctaagaatggaattattatatttatccctggctttaattttccaataaccctccccaatctaaagattaatcctccctcatattgattgactataactattgctttaacaattataaataatgctataattcctaatattagccaaaaccaaaacatatcattcaccttcaacttttttaactattagtgagactccttcaactcctacaatctcaactttatctccattctttattttatctttagactttgctaaccatatttggttctctatcttaatccttccataaccattttcttcaaaatcttctattgctattccaatcattccaacaaatctctcagcccccacttttatctcttttccaacgccataaacaaatttatgtaagataattatcgtcaaaactccagcaattattgcagaaataaatgcatattgtgggattattaataaaactactccatatatcaaaagtgctatcccccaggcaggaaaatataatcctggcactatagcttccaatgctatcactaaaaagcctgccaatataaagatatagccaatctccatctatatcacacattacaatctcccagttgcttaattaattatgatttattataatatttaaaatttttcgtttttgttcagttatgtttatatagggtttatattaaaattatgaaagattttttaaactcattaatcattgaactttggctaaattaatagaggtggaagatatggtagaaaagggtaaaatggtaaagattagctatgacggatacgttgatggaaaactatttgatacaactaacgaagaattggctaaaaaagaggggatttacaaccctgcaatgatttatggtcctgttgctatctttgctggagaaggacaagtattacctggattagacgaagccatattagaaatggatgttggtgaggaaagagaagttgttttacctccagagaaagcttttggtaagagagacccatcaaagataaaattaatcccattatcagaatttacaaaaagaggaattaagccaataaaaggattaaccataactattgatggaattcctggaaaaattgttagcataaacagtggaagagttttagtcgattttaaccatgaattagctggaaaagaggtaaaatataggataaaaattgaagaagttgttgatgataaaaagaatattgtaaaagaaattgtaaaaatgtatgttccaagattgagtgatgtaaaagtaactatcagaaatggaacagttaagatagaattgcctgaatttgctccatttattccaaacattcaaacagctaagatggctattgctaacgaaatattgaagagattagaagatgctgaaaaagttagctttgttgagacatttgaaagaaaaaaggaaactaaagaagagaacaaataaatttatatactttaattaatctaaaatcattacgtagcttttttataattaatttcccaattctatttttaaaaccttaattttttagtagtgagtaagtatgaaagataaatttggtagggaaattaggtctcttagaatttctataacaaataaatgcaatttacagtgcttttattgccatagagaggggcatgattcaaataacgatagatatatgactccagaagaaattgggattatagcaaagacatcaacaaaatttggagttaaaaaaataaaaatctctggtggggagccattactgaggaaagatgtttgtgaaattattgaaaatatcaaagatgaaagaataaaagacatttctttaacaaccaatggaatccttttagaaaatttagctgaaaaacttaaagatgctgggctaaatagagttaatgtgagcttagacacattaaatcccgaattatataaaaaaattacaaaatttggagatgttgagagagtaataaatgggataaagaaagcaatagatgttagcttaacccctttaaaggtcaattttttagcaatgagtataaatattaaagatttaccagatattatggaattttgtagggatattggggctattttacaaattattgaattcatccctttgaaagaagagcttaagggctattattataacatctctccaatagaaaatgaaattaaagaaaaagctgataaagttattacaagaaacttcatgcagaataggaaaaaatatatcgttgatggattggaaatagagttcgtaaggcctatggataatagtgagttttgcatgcactgcacaaggataagattaacttatgatggctatttaaaaccatgtttgttgagggatgataacttagttgatgtattaactccattaagaaaaggagagaatttagaaccatattttattgaatgtataaatagaagagagccatacttcaagattaagtagtattttttaattttatgatatagttgaatattttttcaatctcttttgcagcttttgaatctaagttaataggttttcctaagaattcactttttataacttcttcatcataaggaacaaatcctaaaacttctaaaccaagttcctctttaataatatcttttagtaactctttatcttcattccttactttattaacaataactcctaagttttttattcctaaatcattagctaattttttcattctctttgcagttattagagatttttttgttggttctataacaattaacattaaatcaacagtatctattgtttttcttccgaaatgttcaattcctgcttccatatctaagataacaacttcatctctctttaaaattaagtgccttaacaatcttctcaataaaacagaggctggacaaacacaaccctcccccccttcttcaatagttcccataaccaagagagttatgtttcctattttatagccaactttatctattaaatcatcaacttttggatttattttaaaaatatttccataagtccctggtttagctccagttctttcctctattatgtcatgtctttttgataatggaactatctcttcctcaactccaaaagctaatgccaatgtagggtttggatcacagtcaactccaataactttaaatccatttttttcaaataatctcattaatgttgaagcaataaatgtttttcctactcctccttttccagttattgctattttcattttatcccttaagattttttaaagaaaaaatttctaattcattataaacccccacatatttttataagtttctactaaatatttggatatatcaaaattaatttttatccatttaaaaaagttgcaaacatttgtaactttttttattttttaatagagcgatattataaattaaattttgtataacaaagatataataaaatttttcattcagaaactattgttataaccgtttcatatcgtaagatttatatagtagtttgtcgaaggtatataccgtcaatcaaataacaatacaaaaacttaggtgataaagtatggcaatgagcttaaagaaaatcggtgctattgcagttggaggggcaatggttgctacagctttagcaagtggagttgctgctgaagtaacaacatcaggattcagtgactacaaagagttaaaagatatattagttaaagatggacagccaaactgctatgttgttgtaggtgctgatgctccatcaacaatggacgttgtttcagctgctgatattgctgctaaaataggaagcttatgctacaaagaaggaacagttgaagatggaagtgctgacataaccgttcatgcagaagctaattccgatgacttcgacttaaagaaagattggaacaatagtgcaatgcctgcaaatgcatacgcattattcgttgctgcatcagatggagactattcagaaaaattcgaaaatgatactggaaaaccatcatttatggacaatggtgttttaggcgatgctgacaaaataaacaaaactgttgatttaggagatattgcaacaatgatgaaagttgatgatgttgacccatcagactggtatgacagtgatgatgatgcaggagaaattgtaatggtcgaattaaagaacgatactagtgatggattcactgtctataaaaagaacatgttatatgaaacattagtttataaagatgatgaagagaactttgctaacacaacaaaaatggaagaaggtatgagaattccattcttaggaaaagagatggttgttgttgatattgacaaagatgatgatgcaatatacttaggtactccagtatatgatggaatcataaaagaaggagaaacttacgatttaggaaatggataccaagtcaaaataaaagcaatattaaaaactactgtaaataacactgatgtctataaagtagatgtccaaatattaaaagatggaaaagttgtagcagaaaaatatgataaggctccattagaattagaatacaaagatgacgttggtgtaacagtccataaagcttgggaaaatgttggtggagattacggatatgcagaattagttatttcaaaagaccttaaaaaattagaacttgacgaagaatacgtaactgattggaaagcatacgctgtattaaacgataatggaacaatgaaattagaagatgacttaaatgataacaatgtagataaagttgtaggtattgctttaagatacgatggagataaattagacgacttagatagtggagacgaagtagatattttagactatgttaagtttaaattagatgacgaagattcaaatgacaaattaaaagtatacttctcaatggacaaagatgttgatgctacattaaacattggagagaaagtaaaagcactcaacgcagaagttaaattaaaagatataaaagctaatgcagttgaaccagtttcattaacagcaccaatcgctaagttagatacagaagttagcttagacacagctgacaaaaacttggtcttagttggaggaccggttgcaaacaaattaacaaaagagttagttgatgctggaaaattagcattagacaacaacagcccagcaacaatcgcactcattccagatgctgcaaacggacatgatgtaattgttgttgctggtggagacagagagaagacaagagaagctgctttagagttaatcaaaaacctctaaattccttaactttttcttttttatttttttagatgatttaattcataaatttaaattaattggtgaaattatgaaattttttaacagagagaaagagattaacaaaatcttatcaattatagaaggagagccaaatttaatttattttatctatggttctttaaacagtgggaaattcaacctaacagaagaaacccagttcatatactctattgtagttactgatggtttgttttcataaatagttcctttttgtggatttagagagtagaaggtaattctatttaaatccaactcctcaattaaatttaataacttctcaatatcttcctctttttctcctaatcctaatattattgttatccctgtctttaaacccaattcttagttgctttaactaaagtccaacatttatgccatgttttttgtttatcgtcggatagtttatttattgaatatgtttataagactggagagttagaaggaagagctgattatattttagtggatgactttgataaagagaccgcaataaaatttatggattttttagctgaagagattctaaataaaaaattatctgaggatgagaaagaattaatttattcctatgttggtgggaagccaattaatagaaattgttattgatagtttaagatatgaaaacttaaaagaaattttagatgaaatgtttagagatgaagttcaaaaattaaaatatttcttagaggatgttaaagaagaggatgaggaactttataataaaatagttgatgcattaaaactgtttaaagaaaattatgaaattgaggatataaaaatacctaaaaaaattagagtgttcttagttaagaataacatcttattcttaaatccacaaaaagggagtttaaaaccgcagagttatcttgtctggaacgctataaagatgttattatagtaagatatatattcaattttgatgaaactttttctaaaagtttcttttaaaacctcaaagctttttaatttggaacgctataaaaagattactataatttattaggataatcctgccttattaaaaaatagcaagttactaaagaatttctaaagtgatataatgaaactaactgaaaaaaacattactttatttgctctaacttgttttgtaattatatctactacgtggctatttttaaacccaattcaaccaaaagaaaagcatatagctgaaataaaagaaggagattatgtcgttataaaaggatatatccaagagatgtatgttaaaagagataaatatagacacgttattaatatttcaagaattgttataaatgatggcactggaaatttggatgttgttgcttttggtaagacaagagaagaacttttaacctacatactaagctataatcctatgattaaagaaggagattatatcgaagttaaaggaagggtaaccttatataaggggaagtatgaaataattttaaataatattaaggatttcaaacttctaaaaaagaataactttgagagagatatttatctatctccaacaccaacaggtatctacgcttcaaagtatggaaaaaaataccacacttcaaaaaactgtccttatggaaaaagattaaaagaggaaaatataatatatttttattctgaagatgatgcaaaggcacttggttatgaaaaatgtaagtggtgtgaagaacatggtggttaattatgggaaaatataaaaaattcttcgccatagctgtttgttctctactgttatttactgtttatttttatagagacccagatagagtaataacaaaaggaaataacataattttatctccagctgatgggactgttgaatatataaaattctacgaaaatggaaatccagaggtttttaaagatgggaattgttatgttttaaatgtttcaagatacttcccaaacggatgctatgttgttggtatcttcatgtctccgttggatgtgcatgttaatagagctccgataggtgggaggatagtatatataaaacatattgatggtagtttttaccctgcattcttagaaggtgtggagaagataaatgagagaaatatagtgattataaaaaatggttctgaatatgttggagtggttcaaatagccggatttgttgcaaggagatgctggttaagcataaaagagggagaatgtattaatatggggcaaaaaataggaatgataaaacttggttctcaaacagcagtaataatcccagccaactacaatataacagttaaagtaggagagagggtgtatgcaggacaaacaattattgcagttaaaagaacagataattaatgatattaaaaaaagagttttaaagattagagaagatttaggactgaagaaggtagagtttgatattgtagatattgagatagaagggaaagttttaattatttacacaaaaaacagaactgacaaatcaacaattattggacctggcggctgggtagttggaaaattaagggaggagatgaaaaatagatttgagattataagggttgaggattatactgacaaagttttatttgaagaaattgtaaaggcaattaaatctttatttgatgatgaagttatccaagacatctgtaactattttttatacagaaagattcctaaagagaaaaagaatattatatgcttaattcactgccaatatgatttatatgccttagatattttatcaaatatttttaatgttaaagcaataacttatgatttcccagcattaatcccaaataaaaccaagaagaagattgctaattttttaaataataaagatataggccataaatttttaaaattagacattacaaaggataagataaaaaatcttattgattcctttccctacggatttttaaaagataagattatagaagatttagagggctacgtatttacaagctgtttagatactgcagtttttaaatataataaaggaacgattataaacttttttgaactctttccaataaaaattaaaaaggatgagaattatttaaattactgtcctctatgcattcaaagttgtaaaattgataaaaataaagagaagtttataaaaaaggtagttaaagaggtttataaaggctttaaagaaccaacagatgcatctgaagaaattttatcaatgataaaataaaatatttgcctatacttaaaattaataattgctgttactccaatctatcttaataacaaaaattatggtgatacagttgatattatttttcgaatatgcccttgcgtctggttttgaggataaaaacattttaaaagaagggaaaatgatgtttgatacactattaaagcaatttttggagattgataaagttatatctttactctataaagattttgttgataattatatagattttaaaaaccttgaaatagttaagattaaaaaagaaaatgaaattgaaaataagctaaaatctctcttaaaatctgaaaatattgattatgcattagttgtagctccagaagatgaagacattttatataatttaacaaaaatcattgaaagttatccagtaaaaaatcttggatgttcttctgaagcaataaaaatagctggaaacaaatatttaacttacttagcaataaaagatgccgtaaagacaccaaaaacatttccaccaaaaaaatatgtagtaaaaaagatagatagctgtggagggaaatttaatttatttgatgagaattttttaattcaggaatttattgatggagaaaatctatctgtctctttgattgttggtaaaaaaatccatccattatctttaaataggcagtatattgataagaggggctttgttggtggagaggtgaatattaatcataaattaaaagataaaatatttaacgaagcaattaaagcagttaaatgcataaatggcttaaatggatatgttggtgttgatgtaatagtaaataatgacggtatatacattatagaaataaatccaagaatcacaacaacaatttatgggctaaaaacaaacccaagtttggcagagttattaattaaaaatgcaaacaatgaagaactaaaatttaaagtaaagggagaaaaatttacaatagacaaataaatccggtgatgattgtatgagagacataaaggataatccaataagaagaggcattgccgagcaaagcgaggcaatgcatcccgggtataccaatagggcgaagccctatggttgtaagagagatccaaaggatatcgtgcttaaggagagtgaagatattgaagggatagcaattgaaggtccttggttagaggatgatataagcttagaagaaataattaagaaatactacctaaaaattgggtttcaagcatcacatattggaaaagcaataaaaatctggaaacatattgaagagaaaagaaaaaaaggagatgaaataacggtattttttggatatacatcaaatattgtatcttctggattgagagagattatagcataccttgtaaaacataaaaagattgatattatcgttacaacagctggaggagttgaagaagattttataaaatgcttaaagccttttatattgggagattgggaagtagatggaaaaatgttaagagagaagggaataaatagaattggaaacatctttgtcccaaatgacagatatatagcgtttgaagaatatatgatggaattttttgaagaaattttaaatttacagagagagactggaaaaatcattacagcaagtgaattttgctataaattaggagaatttatggataaaaaattaaaaagtaaagaaaaggaaaaatcaatattatattgggcatataaaaacaacatcccaatattctgcccagcaataacagatggttcaattggagacatgctatatttctttaaaaagtataataaagatgaagagttgaaaatagatgttgccaacgatattgtaaagctaaatgatatagccataaactctaaggagacagcatgtattgttttaggtggttctctgccaaagcatagcattataaatgcaaatctatttagagaaggaacagattatgcaatatatgtcaccactgccttgccttgggatggttctttaagcggagctccacctgaagaaggtgtatcgtggggaaaaattggggctaaggcggattatgttgaaatttggggagatgcaacaataatattcccattattggtttattgtgtgatgaagtgatagtatgctgtatgttgtaggtataggaagcggtaatgagaggcattttacaaaagaggctgaggagattttaaataaagtggatttaatagtgtgttataaaaattacaaaaagtttgttgagaggcttaacaagccaatatatacaactggaatgacaagggaaattgatagagttgattatgccttaaaagaggctaaagataaagatgttgcattagtttcaagtggtgatgcaacaatttatggcttagcttcgttagcttatgagataaacgcagttaaaggttataacgtagatataaaggttgttccagggataaccgcatgttcattagcttcagcaatcttaggaagtccgttaaatcatgattttgttgttataagctttagtgatttattaacccctttagagacaatattaaagaggtttagatgtgcgttagagggagattttgttatatgcatatacaatccactaagtaaaaggaggaaagaaccattcttaaaagctatggaaatattggctgagtttgcaaaggataaagattatataattgggatagttaaaaatgctggtagaaataaagaagaagttgtaattacaaacttcaaagatctttataaaaacttagaaaaatacttggagtttatagacatgaatacaatattaatcattggtaattcttcaacaaagattatcaatggcaagatgattacaccaagaggctatttagataaatataaaatttaggtgaaaaattatgcttgaaaaaatcagagaggagttaaactcatattttttagaaaggagggaggagattgatattgctttaacttcaatcttggctaatgaacatactgtatttttaggaaatccaggagtagctaaatcacaattaattagggctatagcttcccatataaacgccaactactttgaaaaacttataacaagattcacaaccgaagatgagttattcggccctttaagcattaaagagttaaaggataatgacagattcgttagaaaaacatctggttatctaccaactgcagaaatagcattcttagatgaagtttttaaggctaacagttcaatattaaacgctttattatcaataatcaatgagaggatttatcacaatggagataggattgagaaagttcctttgataagtttattcggtgcttcaaacgaactaccagaagagaatgagttattagcattttatgatagatttttgtttagaaaagtggttaggggaataagaagctatgaaaatctctcaaagttgattgatttagaggaagaatataagccaaaaactataattgatgttgaagatgttaaaaaaatgcagaatgaagcgttaaaggttgatatttcaaatataaaagatgatttaattaaaataaaattgtctcttgaaagtgagggaataagaatctctgacaggagatttaagaagtcagttaaagcagttaagtgctttgcctatctaaacggcaaagaaaaagctgatgaaaatgatttagacattttgaggcatatctattggaatgagccagatgagttctataaggtttcagtagaaatttttaaaatatcaaatcactttgctggatttgcattagaacagagggaaattttagacagcttaatgaatgagataaagaaaatcaacaaagatagaattaaattgggaggaatagaatatagaaaatgccttgagattttagggaagttgaatagcatgtccataactttaaaagatgttaaaaataaagcaattgaggctaacaaaccttatgaacttgttgaagatgttttaaaagaggtagagggctttaaaaagtatgttgaagggttattgaagggataagttatgaaaaacattataaagcacgatgcttatgataaaaaggcttatgagagatttttaaagaacagcaaatatttgcaaaaactcattagttattattctcaatatcatccaattcatgaaaaattggctgaagacacattttatgcattctttaaatatgttgttgaattcaatgagtatgttgaagaaaaatttaagataaacaaggctatattagagggagctataaaaaatattgagtatgagaagagtaagctattaactgaactggatgaggtaaatgctggaactgccacaataatgttctgtgagaaattctttgaaaacttaaaacttgcaaaactaaataaagagttaaagaaatttgcatctgaaggaaaaggagaggggttagaggataaattaaaagaaatagccaaaaatactatgaaagatatagcagaggaggtttctgaagttatacaaggattcaatgccgttgaaaactttgggaaaggggagggagataaaaagctactatcgccagaggataggataaagttggcagataaaatcttgcaaaacaaaaagattagagagattgttaaaaaacttggtaagttgagattgttggctataaatgaatataaatcaaagattaagcactactctggagaaatttattcaacaaaaattgggagggatttaaagcatctacttccaaaagaaatcgtcaatctttcagatgagattctatattatgactttttaagaagattcgttgataaaaagctcttaatctatgatattcagaataagttggagaagcagaaaggacctataattattttattagaccacagtggttcaatgtatggagatagggagatttgggggaaggccgttgctttatccataatagagattgccaagagggaaaatagagatatctactacattgcctttgatgatggagttagatttgagaagaagataaatccaaaaactataacatttgatgaaataattgaaatagcatcattatattttggtggaggaacaaactttataatgccgttgaatagggctatgagtataataaaagagcatgagacatttaaaaatgctgacatcttgcttataactgacggttatgctgaagtgaatgatgtatttttaaaagagtttgataagtttaaaaatgagtataatgctaaattaatctctgtgtttgttgaaacattcccaactgaaactttaaaggctatttctgatgaggtaataaaggtttatgatttggcagatgaagaggcaaggaagatttataaatctatatcttaaatcttaaatcacaataataaaatgtttaagggaaagttgatgcccaaaagggaatctaaataccctattcaatatataaactgtaataaatcctattctaaagcaattttttctcaataacttctcctcttggctcaacctcttcaaatatttgagcttcaaacctataaatcttaactccctcagccagccacatatctggtggtagtccagcttttaagcagagatgagctaaatactcttcaacatcccatccatactctactggcacttgtggcaataaaagccctctataaaagccatattcaataattaagccatctctaccaatttttattttttccaaatactcttttggatgattaactttaataagttctggaggagttaatatacttacctcaaccacgatgctatccatctcttccaatgttactggaggaaaccttgggtcttttgttgccgcacttattgctgcctcctctaaagcctcaattaatggcattattggttctggaatccctatacaacctctaagttctttatctggataagtatgtaatgtgcaaaaacatccccttttttcattaaatacctctggataactctctataactatttttttaccagccaaataattttctataactgctcttgcatatcttacagcaaaagttccttcttctaaggttaatagtctcataattcccaccaataaaaattgataaaaataactaaagaaatagtaacgctcagctgtcccaggtttcatcacagttcagtgaagtcggcactcatcatcgcgttaatatttttaaagaatatttttaaagtttatcttttatatcctttagagtgtctttaatttcatttagtattcttgtatgctcacttaatatttcaactgtttttacatgcatatccttaatttccaataacacttttttatgctcttctaattcagcaaatattagctttatgtatttaactccttcatctaattttttgtttaattccaatatatcatcagaggacaatctactaataccttctggaaactcaatgtaagtatttaatcttttttcttctattttttcaatttcaattaatttatctttcttttctaacctctcaatgtattttttaaataattctttatcttcctcatcatcaaagtttgctaagattctaacagtcccatccttatagttataaataatcccattaatgcctaaaccttttccaatattttcaattctatctctaaatcctacgtgttgaacttttccgtaaatttttaactcataagttgttggcataattatcaccataataagttattttgtgttgattatagttatagtttttggttgatttacacctttaaaattctttaattgtggaaaagtgtggcaaaaaaaaaacaatttagtaatatatttatataatttgatatagaatttttattgatttttataagcataattgttcaaaaattgatgtttgatacctactaaaatcaaaaagagaggggaattatggttgtaatgcaatctataacctttgtagtcaaaaaaataagcccaataaaatatgtttcaaaaggtgcatatatcgaatgtgaaactgataaaggaaaaattgctatttgggggagtagcaataatatgacaaatattcaaaaagtgcagaatgctaatacaccattcacacttacttctgatagatatgtcaatccgtcatggattcaacataaatattggatacccgagtcagcaaatatcgtaattaaataaaaaagaagaatataatttaagataacatgccatcaatgcatatcttatgatgtttcgcttttagaacagtacttttttgttgagtatataaaccatgtaataaaagcggacaagtccttgattaagttaaagttattgcactacttagttattaaatctagggaaaagtgaatatggataattaattccctatgtggtgataagatgcttaaggagattaagaatgattatgataaaattcgagagaaaatgacgcaaaagatacaagaactaaatcaacaaataacacaaattaagaaacaaatacaaattatagagcagaataatttatcagatcaacaaaatcagacgattcaaaaaataaaacgacaaatatattcaatagaatttgatatactaagagtagaatctaacagaagtaatatgatctatagtaaaacatttgaagacatgtgcgaatatcttgattcacatagtggcattggcaggatctttgcagaaagttttatgagagaaatagaaaaaaatatacagctaatgaaacaattagtaatgatggaggatcaaataataaaaattaagcaagaaatacgaatgatagaaaaagatctcaaaatttaatataatagtaaatattctcatttatctttgtctaaaaacctatccaaagttatttagcttctttctttttcaactcattttttgaatctctaactaccttcataatcctcaaaatcataaaaaatattacattataaaactatatcaatcttctctccacaaatcttacatcttttagtttctacatctaaattaattattttggcgttgaatatatatctttctatcaacaaagctccacagtttgggcaataagtgttttctccctcatgccctggaacatttccaatataaacatacttaagcccctcttctatagccaaattccttgccatctctaaggtttctataggcgttggaggaacatcagttagtttataatctggatgaaaccttgagaagtgtagaggggtttctctccctaactcatcccttacaaagtgtattataaataataaatcatctatgttgtcattgtagttaggaacaattaaattcgttacctctacccaaattcctaatttttttgctaatttgcaggtttctaagacaggctctaacgtagctttacacactttcttataaaaatcagcattccctttaatatctatattcattgcatccactggaagggcttttaatggctctttctcaatatagccgttggttatcattacattgaacattccattttcccttgctataactgaagtgtcatacatgaactcataatatactgttggttctgtataggtgtaagatattccggggcagttgtatcttatagcaacttcaacaatctcttctggtgtcatctctctataaggaatttcatctggcggaaattgagaaattgtccaattttggcagtgcaaacatctaaagttacatcctccaattgctaaagaaactacttgagttgttggatagaagtggaataatggctttttttctattgggtcaattgctaaagaacaaactttcccataaccaacagcatataaaactccattgatattttctctattccaacaaaaacccctctccccttcttttataatacagtgtcttggacagatatggcatctaaccttattgtcatctaatttttcatagaacattgcttctctcataatttccctctaacggcaaatatctctgtaagaaactttaagaaagttgaaaaactacggttttgtagcttgaassttacgcttcgatttcatyaaaatggatgcattgcttccgtaaggaagcaatknctcttaatctatactgtaagtattttttactaactttcctctaacggcaaatatctcagtaatttccatcaatactttatttttatatattatattatatgttctttttggtaatctactataatttgtttttaaaagtgattttaaataatcatcaatttcagcaattcctatatatttaatctctctccttgtttctaagttgtgttttcttataattttacctatgggaatatctgcagatagtaaatctctctttatctcctctctaaggttctcttcctcaatatttttaaatggtgtttttgatactgcataaactaaaggtatattattgactttgagaataacctctctatagtttgtgttagcaacaattttttggttaattgtctctactctacactccccttcaaataaaatttctaagatgtttgttacacttccgtcagttcctaagagtatcttttcctcattcaataaaggaaatgttttatttagcttagctatttctttataaataatcataaatatcaaccttaatttagttttttgcaaaagttattaaaattcataatgaaaaattgaacgccttcccaaaggaaggcgttcataagttccttatgtacttcaaatgttttgcaaaaaactattggtgatattatgaacaataggatagagaggtttttaaagtatatggaaagtgaaggtataaaaaaggctgtgattttaaagaaagagaatataaactacttcttaggtaaatactttatgagcttttctgttttagtttttgaagaacagccatatttatacgttggaaagcttgacaaagattatgctgaagagcattttaattttttagagattagagagtttaaaagctgggaagagatatttaaaggatgcgatggagttgaaaaagaattatcaattggttatttaaaatacattgataaagagtataagataatctctgacaaaatcaaagagatgaggatgattaaagataaagaggagataaaactaattaaaaaagctgctgagattagtgataaagctataaattgggttttaaataatttagatgaagttaaaaatctaacagagtatgagttggttgctgagattgaatatattatgaaaaaacatggttcaataaagccggcatttgattctatcgttgtttctggtaaaaaaacttcattccctcacgctttacctacaaaagataagattgcagatattttattagttgatattggagcagtttatgagggctactgttcagacataacaaggacgtttttattaaaagacgatgaagagatgaaaaaaatttataacttagtctatgaagcaaaaaaagttgctgaagagcatttaaaggaaggaatttcagctaaacaaattgataacatagttagagagttcttcaatgattataaagagctatttattcactctttggggcatggcgttggattggaggttcatgaagagccaaggctatcaaacaaattgaaagatgatgaggatattattttaaaagagggcatggttgtaaccattgagccgggcttatatttaaaagacaagtttggtgtgagaatagaagatttatatttagttaaaaagaatggatttgaaaagttaagtaaagcagagatttcagaatattaaattaacggcaatgtctttctcaaatctctctcaatcttgtctatctccttggcataattaatagctatttctctcataactttatctatatcttttattcctaaatcttccaatccaataattttaacatgctcagccccttttgatttgacatttatccccaaatgaatttttgcggaaacagttcctttacatgcaatacaaacagataattttttgtcctcaaagtataaatcatccccatctctttttagctttatattatagctctcaatcacttccttagctataaaaaccagtaatctctgccttaaatatattgtctttaaatcaatgacatcaaaatgctctacaacaaaatttatggcatcctctgattttattggggttttaatatctttctctctcttaatatcttttaaatccttcatattctctgtagtaacttccattctacctctaaaaacaactatgctatctttttgaatgtcaaaggttttaaatgcccataatggttctatctcttttccagtgtagtctaatctatccttaacaaagattatagacatatattcagtatcataaacttcaaaatccataaaatcaccatggtaaaggcctatgttctcttttaatatctggaacttccgagaatacatcataggttatattgtttaatataaaaccatccatttcctttaattgaaccaataggcatcctttaatggtaacattaattttaggagcgtttttttgcatctcatcaactattagcagtaaatctctaattcttcccaagttattcaaatctattccagcattttttaagagattttcattctctttgtatgagatgagttgatgaaccataatctcatcagcgtagttgttgagttctttagctaaatttaaaagctcattatcattaaatcctggaatataaatagacctaacaattgtgtgtaaatactttgaggcaatttttatattatttaaaactctattaaaataatcttttccagttaatagtttatacttctctctactaaaagagctcaaactaatcattattaagtctaatcccaaatctttaagctctttaataatctcttcatttaacaaagttccatttgtctgtaaatcaactctaagccccaaatctttacaaaactctatagcttttttaacaccttctaaatccaacaacggctctccatattgggatatagtaactgtctcagcctcttctaagtttccataaattcctctttttacagtttttagccttgagtagcaatatatacagttcaaattgcatttttgtgttaattctattgagggatgatgttgaggattttctatctctaagtttatgccttcacagccaatgcaatgtctaacaaatttkaaaatcttagctatattttccaatttatcgcaaatctcatttcttaaaactatcatgcaaatcccattttagtttttatcaatctaaatcttttttaaatagttctttattatatcctcaagttctttgctatattttaaatgcactggataagtaactcctttcttcccaatgagtatgattttgttattttctatcttataaccttcaaaacctttccatgttataaatctaaatcctacatatatcccattcttgcaaacacggattttgtattttacaaacaacaaaccaaagataaacaaaacgaaaaatgttatggcaaatgttaaagaaaatctaaaaccttctggcagtttttcccagaataaatacagaaaacttccaataaaaaatataggaaacccaaaagctaaaaaaatcattaaagcatattttttcccaaatacgttaaagttgttatccttatagacaaataaagcatcttttattaaattcttttctgattttattgctaaataaatcccataacacaaaatcccagctaatgcaagcttgattaacccaacgtacgatataagaattactccataggagttcataaactccccttatcagtgcttaataataaccagcagtattcatcttctctaacttatcctttaattttaatgcctcttctatctcctcatccttcaatggtctttctgaagcaatacaaacaatggctttgtctatataggtatttttaatcctcataccctctggaaacaccctacccataaaatccataaccttatctatgaaatccttacctgcatcataaacttccatatctaaatcaatatctgaatctgtaacaacctcaaaccttgatggctggtctatgacgtgtatcttttttaacagatgtgggagatatgtctcatcagtgatttttagcttgtatattattttaccaccttcttttttttgctctacaatttcagcaaaatctctcaacttaatagctcttcttgtatgttttggtaaaacccctaatataaaataaggttctttctctttagcaataaattcaaccctaattattgattttcctaaaagcaaatcttccaacgctgtttgtatgacctttgtataaatctccttcccggctttatcttcacaatggacaactatttcagccatgttatcaccaattataacactctctttatagcattcgcaaccataggaggaaacctcctattggtatacctcccgtccattaaccaattatcaaagctaaatcatctattaaggaacatttagaagcccaaagggttctataagtgccatattaatttaaaaactttgataattggttataagttgggggctttcagccccaattaatgtccaatttttaatcataataacctttttatagcattccaaactaaataactttgaggttttaaaatcccttcaatgggatttaaaaataagatattccttttaatcagataagtataaactggcaccgggatatgttttttactaacctcatactcatccttaaataactttaaagcttcaataacattatcttttttaatctctataacttcatcaccaacatctacctttggttttgaataattcagcatgtccaaaaacatgtccaatttttgaactgcatcttttagcataaactctaaaatctctcttaaatccttaaatttgctttcttcaacaacgtattttatgtcttttggctttccaccaacatagctatagataagctctttatcttcgttagttaggttaatattattctccactgctaagaaatccataaactttaaggcagtttccttgtcaaaatcatccactaatagatattttgcccttccctctaactctccagtgctataaacgtattcaataaataagctatctgaacttagacaaaaaacatggcatagatgttgttctttagttagagagactaaaaactgaaacaactcttttaataaatacttctgcccatttccgaagcgaagcgaaggaaacgctgaaaatctttgattttcagtgttcaatacaacatctttaatcatctgaagttcatcaaaaattaatattggctttttcccactctttttaacctctaacaataagctgtttaagtattggaaggcatcgtttatcttctcctcaaatagtttatcaaactctacctctggtattggaattccagttaaaatcctaacacccttggttattagattcaaaacctcatccttatccttaatcttctcaaagaaatcatcttttttagtggtaaagatagcttcaataaattccctcttttctgaaattaaataagtcctaaaattaatataaaaaaccttataatcatcacttagtttgttttcaatgatgtgttttattaaggcagttttaccactatttaaagggccatagataaaataaatatcatctggctctctatttaaaatatggagaatttcattaatctccctctctctatcaaaaaatttcataattccaccaaaaatttaaaaaaattatgccttcatcttcttgtatctatatccagatgataataaagctgctccaacagctccaattaactgggagtatcttgggacaataatctttcttcctaaaacttcttccatagctataactaaacctttcaacaaactacttcctccaaccaatataactgggtctctaacatcaacctcttgtaattgttgctcaaacacttgttcagctactgagtgagctgctgctgcagcaacatcttcagccttagctccttcagctaatgcagtaactaaatcctgaataccaaagactatacagtagctgttcatctttatctttctccaatctcccttagctgccaattctccaagctcttgtaaagaaacccccaatctccttgcagtaatctcaaagaacctaccacttgccccagcacagattcctcccattgtaaatccatctggaatggcatcgtatagagatatagctttgttgtccatccccccaatatctataactgttgcttctccttcttgcttatcagctaaatatgctgctccttttgaattgactgttagctcctcttggattaaatcagctttaaagtattctccaactgtatatctaccatacccagtagttccaatggtttcaacttggtctaatgatatgccagcttcttttaaagcattattaactgcttctttagcagattcaataacatcctttgtatatatccatccagttccagcaacttcatcatctatcataacaactgcctttgttgttgtagaaccgctgtcaatacctaagcttattccctcctgcttttttcttgccaataaagattttctttcaacaattgtggttaatgcctccattcttgttaataactcagatgcttttgttctctctgtgaatgaatacataactactggcagatttgtgttttgttgtataagctttctaacttcatttcttaccaaagctccttcagcacatctaaaacatgtagctataaacactgcctcagcgtctgtatttccttcaataattgacattgcccttgcaaacatcaattttaagtttgctgagccaactttaaaccctaatctatcctcaacttcatcaatatatgataaatcaacctctggaaaaatgagttctccaccaactttttgtgccgctttttcaatttcgtgataaactccgctccattcagcaccacatgttaataatgcaatctttaccattaacttcacccaatttaatatttatatagtaatgaaacttttcttagtttcatcaaaatatattgttatctgattcttggtttatttataaatatcttcaactctaatatttatatggaaatttttttattaattctaacattttattttcagatatatattcctttgtgcctataatcagctttggtttttctaatattctaccaaacaatactacagggcatttattttttaaagcaatatctactactttttcatattcttcctctggaactgctattatataagtccctaaatatcttgtagcccttggatatggaagggactttatctcagctcctttttttgccttaattaacatttccaataaattccctaaccatcctccccttgatgcatccttacatgcgtttatttttatcccattctctaagatttctaagtatgtgtcaaattttttctttgctttataaattctctctccaacatctccctctactgggtctccaagcataattagtaaatctccatctttagctcctccatcttttattatcaaattttcatcaatcaactccccaaaaacagctactgaaatacaggatttcaattcttcaaccgtttgtgtatttcccccaattattggaatatttagtcctatactttgttttcttaaaccatcaacagccaactttatctcatcttcattttttgcttgaatggcatttaatgcaaattttggctctgcccccattgctacaacatcacaggcagtgtgaattaaagctgttttagcccctaattttaaaggatagggcccttccatattaataaccatgttttttataactactgcatcatctccagctttaattccactttttaaatcatcaattaaatcatcaaagtgccaaaatgcctttcttggatagtttgtttctaatatatgctctatagccatttttagctcgtattcaaaattttccattttcacaccaactttttataaaattctttagctttttcaatatttccaacctcttcataagttaaagcaataatttcatatatttcataatgataaaggtttatttcctttaatttttcaaaacattctattgctttctcatcttctcctaaataaatgtatattcttcccatagattcataaatctgttctaattcaaacacatttggatttaattttaaagctttctcaaaatattttagtgcatgtttatatttcttcaatttgaagtatgtaaaggcaacttttaaaattaaatcaatatcatctggttttaattctaaagcttttttaaagtagtttatcgctttttcacaatcttcttcataatataactctcccaaatattccaatgcttctacatcatttggatttaattctaaaactttttcaaagtattttattgaatttttattatcactcattaaataatagctctttcccaatccaaaaagtgctttatagttatttctatctttttccgatgccttttcaaaatattttattgctaaatctcttttatatagttttaataaagcatagccctttttacatagaagttctgtattttgatttaactctaatgctttgttgtaacaaaataatgcttcataataagctttccatagatatgctttatctccaaggtttttccaaagtttccagtttttaatatctttattgcttaaacttaaaatacactctatttcacccaataatttatcaatatcttcataaagagttgataacttattatatatcaaccttaaatcatacaaactcgaattatttggactattttttgatatttcttctgaaatttcattagcagtttctattagcttatcaatctcatcaataagcatttctgtaagttctttcccaatctttaacctattttttaaaacattatttttcaataagtttaaaatttctaatgtgaagtttttgtccattttaatcgccataatttattattatttattattcatttctcaatgactttattgggtctaattttgatgctttatatgctggatataatgctgaaatcagagatgttaaaattccaaatattatgccaattatcatatagaagattgcataataagacagtgaagtttttaacagataatgaacaatcaaatacccaaagaataaactcaaaaatgccccaattaaagagccaataactcccaatatcaacgcttcataaaggaataaaattataatgtccttttttgatgctccaatgcttctcataactccaatttccgttgttctttcaacaacactcatcaacataacatttccaattccaataccagcaactaacaatgaaatagctccaatacccattaaaaagtaagaaaccttagttataactccgttaatcgcctccaatatagagtttaaagatattattatgcattttttctcttttctgtttaaaattttatctgtttcattttttattttatcaatatcatttatatttttaacatagaggattattcttgaataattgtaattattttctccataaaaccttctgtatgtttttgccgttaaaattaaagaattatctgggaataaaaatgtgctgttataaatcccacatatcctcaatgagatatttttaatctccaattgatttccaacattaacatcattaacattagaaaagaacgtatcaacagcaacagaagtgtcagaaaccttcactttcaaatttaagtattttatgtcatttttatcaatgccgaagatgtttgcgtatgcttttctattctttccttttatataaacaaaatcagaagtagcataaactggaataactttgcaatttaaaactctcagtttttcaatatctcttttatcaaaagaagtataaccattttgataatttggaaaaacaattatatagttagatatgctccccaaattttccataattccttgttttaatcctcctcctaatattcccaaagaagatattgccgcaacccctattataatccccaataaagctaaaatacttcttaacaaatttctttttaaatttctctttgctaattcaaaatacatactctcacttatttaatttgttattttatccaacttcttaaaaagatttaaaagaaagaagaataacattaatgtcgtataacctctcatgcttgggatgtgattttcaaaaaatgttaagcccaaaaataacgtgattcctaaaataaaggtaattccaaagaatatagtgaaaaattttgcaaaatccttaataatatcttttgacgaaaaatatgtcgaaattgataaagataagagaaaaccaataatatggataaaatcataaaactctataatatgatattcatcactcggataagttatatattttccaattaaagaagaaatgcttccatctacaaccaaaattataaaaatatacaacaatatcgctactacaactgctctaactttatcgaagtttgagatgttatctatcatcaaatcccctcaatttttcttccctctcaacctctccatcttttaaataaattattctctctccaaatctcgcaacatttatatcatgggtaacaacaacaacggtttttccatcctcttcatttaatttttttaataattgcattatcttttctcctgttttgctatctaatgctccagttggctcatccgccaatataattggtgggttgtttgccaaagccctcgctatagcaactctctgttgttgccctccactcaactgatttggtttgtgattggcaaatctctcctccaactctgccatctttaagcattctaaagctctcttcctcctctcttctccgctcattgctcccctatatttaaaaatcagtggaagttcaacattttctaaggcagttaataaaggaattaagttgaattgctgaaagacaaaaccaattttatctcttctaatttttgttaattcatcatcatctaagtcattggtctttatattatcaatataaacctctccctctgttggtttgtctaaacagccaataatatttaacattgttgattttccactgccagaaggacccataatcgaaacaaactctccctcttttatattcagatttacattttttagagcataaataatttcttctcccattttgtatgtttttgttacatttttgagtttaatcataaattccccctaagaatttttaaattatttcgttaattactattttcttaggaatgcctttaatttttaatattgtttgatttttgtccttattagttgttttttcaatctcttcccagctataaaatgcaataccctcaatcaatatccctttttcgtagattcttatcctataggttttataaaactcagaaattgtaaatgccactataaatataaaaaataaaactgcactgttataaaaagtcccagagaagtatataaatccagcatatcctaaaactaacattaatcttaaaattttataaactctatttccaaatattctcttaacttcttttttaagccgtcctttatctatctttaatatttttcttgagatatagattaaaattaaagtaattcctactaaacttccaaaagccagcagtataaatagcagtattgatttagtaattaaaagtatggatacgattgacgcgagtattaaagccattccaatataaaaataaaatggatttattcctttcataatatcactttttctttacgaatcccctataaattaaataaactactccaacacagaacaatatagctattccaacaactaaataattaattcctccattattattagtctttaaggaaaccacttctttactgatttttactgttttatatatggttattaggttgttatcttcatctctatagcttattttaagtggaatttcatttacatttccattaatttggcagtgcagttcaaaactaccataatcatctggatttaatgttccaacgaagtagttttcatacggcttttttggaatgatgttttttgttttttctattgagattaagacgctctttgcctttccagttccaatgttgtcaatatctccagttatctttatttcgttaaatgaactttctatatcaatcccacttaaaaccaaatctgcctttcctacaacatttattgttagatttttctcaatctgattgttatcgaaatatataactataggaattgaagtaactccctctttatctacttttatttggaaagttagattttttgtctctccttttttgatgaatatagatttttggttatttccaataaagtatttacttatttgaacaacaaataaagaatctttataattattttttattgaaattgttagattttctatctttccaactgtaatagttgggttttttatatttattgaaattaactcatttgggaatacattgaaggttaaaattccagtttcttcaactatgtttttattttgatacgttaaggtctctgtttttgagtccccttctattgtctctgatttttgggttaattccaacaaattataagggttcttgtaagatattttgtaatttatagaataaactccttcttttttggcaaagatagttagtggaatgtatgtagatgtctttgaacccaaggcagatattgtgaaagtattatctcctaaaaccattaaattattcgagttttgaaattctatttttatattttcagcagttcctgttcctttatttgtcaatagtaagagaatttgattattaccaacttttagtatattattagtggtttctataactaagtttgcctttcctctcactggaagggtaaaaattctattttcagaatattgctgattaccttttgtatagttgcaataacctgttatcttataatcataatttggtgcattaggatttatttttattattaagtgagctacaccatactcataaggaaaaagatgtccaatccattgctttcctctaataatctctatgttttctttggatatttgatttgttggttctatatatacaactgtattattgatttctttgtctgattctattgttatatataaatcataggttttagatggctccaagtattgagcgttataatcaatatttttgaaggttatataggcagaaacctgagataaaagaaataggaagataaagatgataaataagttttttaatctcttcatctttttccctcattttatagtaactttaatacactgtatagttgatacaaaccaaatataactgttggaattagtgcagttataaacgcatttcttgttgtgagatttctcgcatataataggcaataggtattgttattaaagctccaactatatttggaaggaatccatagccagtaaaggataatgttttcttaaagcttccttctcctttgaatatcattgaaatgagatgcataaatccagctataattaaccatgcaacaattccaccaataaatgtggatattaacgcaataatcttggtaaatgccaatacttgctgatactgtggaggaaagattttgtatataattgaagttgatatgtaggcagaaattgctatcaatatggaaaagattaaaacaattaaaaatggttcttttagagagatttctttttgagagagttttttgaagaaagtgtctggatttgttaaagcttctattaaattcattagtatcacctattagatttttcaatgattgtatttgttacttcaactatttaaatcttacgttagtagataagtggctatctttggagtgatataaacttcaataaaagcggctataacgattagaattattgaaattagagataattttaaaaagtccttaatatcttcttctgtaagtggtttttcttttttatctaataagtagagagttactttgtaaggaattttaaaacctgctactgctgatattaacattgctgagatttcgaatattccgtgtggaagaattaaagcggttattaattttaacggttcgttagttagggaaatagaaccaattaagacaccaacattaaaaccgttgaatattagatttataaaagtagataatccaaaagttatagaaccagccaacattaggaagataacttttaagttgtttgttaatattgaaggaaagttaaactgtatattgggtatatagttggataaatccttatcgttaatttttgataagttgtttattgagataaatccaaaaataaaacccaatgagaagagcattagagttaagattattggtattttcatggtttcacaattgttaaagttattatttattttatcatcattattgtatagtatagtgttctaagtagtacctcttattttatgtaataatattgtcctacatactaatgaaccaaagataaataaaggtacaaaaattgcacagaatgtaaagaaaatctgaaatatagcagtaaaaccataatataataattgcttatttaataatataatcagtaataataacgaatagaatatcgaaaccatcacttcgtattgtgcaattttaaatatagtttttaatccattattctctaatatatctctttttaattcttcagtagatatcctacatattttattataaagagcaaatgatgtaataaacccagcaaatatagataaaacaatcaattctactatctggcgatatacaaaattcaaattaaatttattaaatgtaaatgtagtatcaagtacaagtataagcatgaaaggcataaccaaacataagaccaacgctaaataagtgaaagacaatataccatttaatttcttttcaaagttcatgtattatcacccattatatcacctaaaaaatatcaaaaaattattaaaattaaaaaagaaaaacatttttaagctaataccgtagtactaaacacaacagtaaatactccagaagccaatcctgcaggacctaatgcagcagaaatagccgctccagtaatagctgaatccgcagctacaagataacactgctgagctgtatcaatatctcctacatagtattgataatacaatccagcatctcccaaagctattggctcagccactaaagcccctatcatacttactaaaatcactgccccaaaaatcttatatactcccttctctaaaaatttcatattgccacctcttaaggtggttgtgtaggcactggctcagctccatatagggagcgtcatcgccaactattctttaattttttgtatggtgcccctattattttccacatttttcacaaatgtaataatacaaaacctctatatatattatgatttaaagttaaatagtaaattatatatgttaaaatttttaacttattagaatttttaataataaaacaattataactttaaaaaagtaaattatttttaactattttataattttatatcaaaaaatgaaatataacataatcaatattatttaaacacgattaaaatgcattggtgaaataatgaacatcttaaggagaggaagattaggaaattcaataaaagaagatgtagcaaaatacacaacaagcttaagctttgataaggagatttttgaagcggatatcttatgcgacatagctcacgtaataatgctctatgaacaaggtataataaaaaaggaagacgcaaaaaagattattgaagggttaaaagagatttataaaaaaggaatggaaaatctcaacttagacccttccttggatgatatacacatggtcattgaaagtgagctaattaaaaaacttggtgaagatgtagcaggaagaatgcacactggaagaagtagaaatgatgaagtagcaacagatttaagaattgcattaagagagaaggtcttaataatagctaaatctttaattaagatgttaaaagatattttagaattagctgagaaacataaagagacattaatcgttggatatacacatttacagcatgctcagccagtaacttttgctcatcatttgcttagctacgtttcagcaattgaaagagatattttaagattgttagatgcttacaaaagaataaatatttctccattaggttgtggagcaatggcaacaactggatttaagataaacagggagagaactaaagaattattgggctttgatgctttgatagagaattcaatggatggtgtttcagcaagggactttatattagagacaatggctgacttagcaatattaggaacaaacttatcaaaaatctgtgaagaattgattttattctcaacctatgaatttggaactattgagattgctaatgagttctgctcaacatcttcaataatgcctcaaaagaaaaaccctgatgtggcggagatagcgagagctaagctatccaaattaaatggaaatttggttactgcattaacaatattaaaagctctaccaaatacttataatagagatttacaggaaataagcccacatttatgggatagcgtttatacaacaatagacacaataaaaatggttcatggaatgctaaaaacaataaaaattaataaagagagaatggaagaattagctaaagcaaactactcaactgcaacagaattggcagatactttggttagagagacaggaattccatttagaacagcacatggcattgttggagaagttgttagaagaagtatagaagaaaaaaaggatatgattgaagttatctatgaagttttagaaaaatacaatttgaaagttgatgaggagaagataaaaaaggcattagacccttatgagaatgttaagatgagagatgttatagggggccctgctccagaagaagttgaaaaaaggataaaggtatttagggagagattagacagatatgaaaaagaggttgatgagaaattgcagaagataaataaagttaaggagatacttttatcctatgaaatttaatttatttttatttgcattttatcaaagtaatgataaaatcatatatttccaaacataaactgccattaaagcccatattgccactaaaatatacccttctttttttcttaatttatagttagatagtggataaaaagccctaaccccagctggtgtcattgtatctccaactaaatgagataaatatccaaaaacaactggtagtatatagtataaagctccattaacatttatatttggatttaaaatatccaaaacagcccatgcaaacacagcaaaaatcataactctaccaagtaaaacctcattggtaaccattaatagagatatcagtccagcaaaaactgatgagataaatgagagtttgtaagctaaatatcccaaaatagaggatacaaataacagagaccaaaatgtatgtgttaaacctctatgatctgaaaaatatggaattaagtatattagaagaattaaaacccccaaaataaataaatcaacattaaatagatgtttatcaaaaaaatacagtaaaatatttataaaaacaatccctccagatattaaaagccctcttttaacaatatcctccttaacatcatggtctaaatctggatacaaggctccagctaaagctaaaaatatctgttctggtgaggagataaaaggcaatccaaagataattcctaagattgtatgtcccttccaattcataaaaaccccttatatttttatttttttattttatttacccaattacaacctctccctcttttaatccaatagtatttagtcctttaacaactgattctttaataatttcttttttccttcttaatagatatagttttatgtttaaagttatcaaatccttagtaattttaccaactgcctcaaatttaataagatttttaagtaaatcatacttatcaacgttaaatagttttgaagcattaagaatttcaattcctacaacatcaccattttcatcaaaatcgattaaaatatcatctaaatccaaagtttttttagattttgccccctctttataaactaacaaattatcattttcataatcgtaatctattttaactttcattatttttccctcctttttctatcttgtggaaatattgtaattaaatttatttgcaatggttcaattgactttatgctcataactacaacaacatcatgtttttcatcaaactcataatataccttaaaaatttatcatccttctgctttaatatcccaactggtttatttttagttaaaatttcaaatagctcttcttcatttggtatattatcttctctaagttcaattctaatttcaaagtgtttggttttcttaaaattttcctttgtagcattagatagataattaagaaattcatcaatatccattaacttcaccatctcaaaatcaaaattttaaatcaaaagctcaaccttactatctctaagcttatttaatatcttcaaggcaatatttgggataaaggttgttatatatgctttatctgcctctaataccttcttatcatctccattgcatggataagcattgattcctgcctcatttaaaattttgatagtggctttctccacccaactatcagtatctgaaatataaacctcctctgctttttcagcaattgcccaacttatatatctccccccaatcaatccaaccttttcagctgaaatatcatcaatagttttatttatcttcaattttttgcataaattactctcctttatagccgcccagtgtgcatctcctaaataaaaccctccaatgctgtaagggtaaatattccctttcaaaaacctatttcctaaggcaattgctttaaccatatctttatcaataaatgttgcattgacatttcctgctcttatttcctctttaattattctcataactcttctcaatccaaaattccctctctttgcagtttttgggctatagccgcacatatacccatgatgatttaatggaaagccagttaatattgtatttagcccactccttaaaccaactctgcattcatcctcataagctccatttgttgccacaactcctcctttaaccaaaatccttgagacagctatagccttagcaaaagccttcaacctattcttagccctattaaatggagcaccttcaacaacaaacacatcaacatctaaatcaatgcatgctttaattccagttattaaatcatcatatccatctccaatgtggaaaatgccttctaatcccttaccatactttttagctgtctctgcaacaatcttcatctcttctaacggagctgcatgctcctctccaccctgctcctcaacaacatttatacagagggttgatgctaactttatccaatcttcaaattcatctgcatgctctttctccttctctatcaatctcttatgaattctatttcttggacaacctttaaatggtggtcctttaaagtaacaatccccataacagtgagttatctcctttggaaacctcataggtccatacattccaaagtggtctatatctattggcacatcaacattttctaaaaccatttttaaaacttctattggctttaaaccctctttttcagcaatatctgctaccgcataactgcatatatgaattggaaatcccatataatcggttaatatacaattttcaataaactgaattaatgttaatgatgatgaacacggccccacagcaatctcaaccaaatcacaccccattgggaatgttcttaaattactacccaatttttgaatctcttccaaggataaatcatcaactgcatcaacaatctcaattatgtcgctttcttttaattttttctcatttagtttttttataatcagttttcttagctctaatgctgaatctaagctattaactgcctctttaatgagttctctcataaaaatccctcaatttatttataacaaccttttaagaaaggttgatcaaaatggatgcattgcctcgctttgctcggcaatcagatgaaattcccttggaatttcattactcatctcgtttcactcgatgatgcctcttccattagcatttatttattgaggtatttctgaatcgattgtataatttgcagatatctatcttcaatcctctcaactaaccctaaatcatagttgtgtgtttttaagattataatgttttctatatttttcccatcaaacaaataatctggaattattaaaataccattatcagagatttctaagcctaaatcttcaacaacctttctaataaactctgtttttggattaacttttacattcaaatctttaaccaatttttttatttctttttctttattttttaggaattctattgatttatctatttttccttcctttcctatgcctaatttttttaattcttctaaactcttaattaaatccataaaagttgctgatttaacttcaaaaatctccgattctggatttagctttttaactctctccttatatcccttagatataattaaaaaatcacaatcaactttggtattgtagggattaactatctcatactcttccaaacctatcaaatcagcaatctctttatacatctttgttattccaattttcatagttccacgtatcaactgttttattcaaaactatctctttttgatttctttcagctataaacccccaaaaaatttatttacctcttgcattctatcaccaacttatcaatctttaaaatcagcctatcatttaaatcctctttaccaacctccccccatttataaaagcccaatggattaataaaaaccccattttcataaaattctacaataacatctccaacaactattgaaataattataaaaaacgcagaaatcgaatataaaacaaatttagtatatggatttatgtttaatgatactaagtttccaaaaagataaaaattaatcccaacaataaacaataaaactttcaaaattttatattttttatttaaaatctttaattttgtgtattttttaattaattttcctttattttttccagcaattgatttaataaataatctaattaaaataatggaaatcggcaataaacatatcaaaatgactcccgaagttatgattattgtttttagacctaatccgaatgttagatacactaagccaaaaataaaaaattcaacaaatattacactacctaagataaatggataggctaaataaacactttctcccctcatagttccacacttattattttccataaatcttcaaataattctcataccttctccaatccaactttggctttaatcccaaatccataatcatcttaacaacttcctccaaattcccagtttttggatttccaactccctttacgttcattggatgatttttaggaataaccgttgctacattactcgcccctccaaataatgcaaactgcaccaactcagcccctatagttggtgttggtgatgtaatccttatatttggaaatatcagccttgttatagctatcgtctttgcctgctccaaagcagaacattttggatgattctccataggagttcctttgtaagggttgaaacccattattggaatttccccaacatttaactcattttttaaataaaataaatgctctactctatcctcataactctccccaataccaatcaataagccagtagataactcaatatcatatttattaactaatttacaaacccttattctatcttccaactcctctcccggcttaacctttttaaaaagattctcatttattgtttctaaattacaacatattgtatcaattccatattttttaagttctttaatagattcctctgttaaatcagcccctgcattaactaaaacttccaagtttgtgtattttttaactatctttaaagctcttattacttcttttccttgataaccatgtgcagaagagcaactaactctttttatcccactctcttcaatggctattgctgatttttttatctcctcatctgttaatctaaacggctcataatagccctcttttgaagttccggcagcaaaaccgcaatataagcatttaggattcacatggcagatgttggttatgtgaattgttgatgtgatctcaatcttcttcttaaaataatccctaacccttgaggcaatgtcaaatagctttaaataatctctccaattgtctattttaaataattttaatgcctcatcttcatctataagcccattttttataaattcgttatattttcttctactttctaaaaattctttaaactcttcttcaatttttccaaataccattaaatcaccagatatttttactttacttattttataagtatatttcacacttttatattttattttgcattaatattaataataatttttaatattttctgactttaatatttttaatgtatttttttgcaaaaaaagaaacaattttcctgtaaattttttaatgaatttttatagaaaaaatgaaaaattatcttataaaaaataaaaaattagaaattaagttaaattacaatttattttgatttaaattttacctatccctttatttattccttttgagacattatttcacattttgtttttccttcttcttcaactactttgtgtttttctaagacctttaaagcagttggtaagatctctgccaatggaccaaagcacatactatcagcggttcccaataaagcagctgggtctaacgcctcctccatgtttgctattcccttctccttcattaagttgtgaatttgtgttaaagcttcatcagccatcatctgagcgaagtcagctggagctcctaagatctttgtaactgcatctctgtatgctaataaaccagcataaactgttgctgtaactgctgaacacatatcacagacaggaccaatcaagttagctggcattttaaatgcttttcctcttgcaattttacctatttcatataatttattaactgcctcttcacttgcataaccttctgcgatataaacttgtcccttcatctctggaacacatccggggtggtatgaggtgatgtttaaatcctctcttcccaagtctttaaagattttagcaaactttgttgttgggattgtacatgcgtgggttacaatagctccttctggaattgcatctgcaaatttcttaataatgtctggctgtttgtttccttttggtaaccatgtaattacaatatctgctccctcaactgcctctctatcatctgatgttacttttaaaccaacatcctctggatggactaagtggatacatgcctttggtggttttggcaactcttttgcctttgccttaacaacttctctaatctttggcattatgctctctgggtttccagataagtgagcttccatgacttcttttgggtcaaattcatcaataacaactaatcctggttcttcagcaaagcatgggtctgaaacaataacttctttaacatcaggaactaagtgtaaaagctcagctccataggttatagaagagtgtgttaaagcaatttctggttttcctacttctttagcaacttcacaagctctcataaaattggttattcctgctgctgcgtgggttctgtaacatccagctcctaagattgctattttcatcctctcacctttttgttaatattgtgagtgactttggtaatattattgttatgtttggtaatatataaaattatctatttggttctaagtagtaaatagccataaataagtattatcaatgatattatattttttaatagccaatatcaaaaattaaatataggctaaaagaaatccatagtcattttaaaaagttctgtattaaaaggcatttataaaaaccaaggggcttttatatccattccttaataaattgtgaatagttttgaaaatgactataaaatagcgatacatctgataggtgaggcatcaatgtcaaatatcttcaaaggtagtcctaaaaaataaaaactcttaccaactaaattcttcagattttcatttagattttcaataattaaaatattattggataagagccttttatgctcctcaaatccaccaattgtgcaagcatctataccaacacattttatgttgcttttaataatatcatctaaaaatggtatttctggaattttctcaaaatattcatctctaccccaatattttgaaaatccggtatagattaacaaaatgtcacatgcgggtaatttatttctttcaaaatcatctaaagatatgcaatacccttttcccttaataattccatctttaaatggaatcctattttccaatccaacatgttttggataatctatgtgtgtgcagagatgagaacccatgattatttctgatactataaacccatctatctttttctcaataattctcagttctgggtctccaggatacggaaaattgattagagtttgagttaaatctaagatttccatattttcacttcagttttatatatttaaatgtattttcattaagtatatatacctcttcaatccacatatatataaagttttcgaaaactatatatagtagttatgaataaagataaatcagcatatatagrgggagcaatttgaaagtagagatacttcacaaaacgccaaagggtttcttaatagccagaggaaagagagagataaagattggttcagtagttatttttaagaacaaaaagattggtaaggtagttgatatttttggcccagttgctaagccctatataaaaatactccctattaacaaagatatagaagtttctggaactgcatatataaaaaacgataaatctaaatataaaaatactgagaagaaaaattaaatttaaatggtgtggcttatggaggctctcaaaaccaaagaaaatgaaacaacaaaagaaaaaaaactcacaacaaaagttgaaaaatctgaaaaaaaagaagaaaatgttagagaggaagagattgtttgtccaatttgtggtagtaaagaagttgttaaagattatgaaagggctgaaatagtctgtgctaaatgtggatgtgttatcaaagaaaaattatttgatattggaccagaatggagggcatttgaccatgagcaaaagattaaaagatgtagagttggagctcctatgacttatagtgttgattacaacgaaccaataatcattaaagagaatggagaaataaaagttgttaaaattggagaacttatagataaaattattgaaaactcagagaatattagaagagagggcatcttagagatagcaaaatgtaaaggtattgaagttattgcctttaacagcaattacaaatttaaattcatgcctgtttcggaggtttcaaggcatccagttagtgagatgtttgaaatagttgttgaagggaataaaaaggttagagttaccagaagccatagtgtctttaccataagagataatgaggtagttccaataagagttgatgagctaaaagttggagatatattagttttagcaaaagaattgccgaatattgaagaagatattgaaatagataaaaaatttagtaaaatattgggttacataattgcggaaggttattatgatgacaaaaaaattgtattatcttatgattacaatgaaaaagagtttataaatgaaacaattgattatttcaaatctttgaattcggatataaccatctatagtaaagatttaaatattcaaattgaagtaaagaataaaaaaattatcaatttactaaaaaaattgagagttaagaataaaagaattccctctataatctttaaatctccttatgaaataaaaaaatcattcatagatgggatatttaatggtaaagatgcaaaagtatttgtctcaaaggagttggctgaagatgttatattcttacttttacaaataaaagaaaacgccaccattaataaaaagagtataaatgatattgaagtttatgaggtaaggagaataacaaatatatataccaatagaaaactcgaaaaacttataaactctgatttcatattcttaaaaattaaagagattaataaggtagagccaaccagtggatatgcctatgatttaactgttccaaatgcagaaaacttcgttgctggatttggaggatttgtattacacaacaccatccacgataaaggtttatcaacagttattgattggagaaacaaagatagttatggaaaggatttatctgcaaataagagagcccaactctacagattaagaaaatggcagaggagaattagagtcagtgatgctgcagagagaaacttagcatttgccctgtcagaattagatagaattacatcaaagctcggactaccaagacatgtaagagagaatgccgctataatttatagaggggctgttgagaaaggattaataagaggaagaagtattgaaggagttgttgcagccgctatatacgctgcttgcagaagatgtagagttccaagaactttagatgaaattgccgaagcatcaagggtggataggaaagaaattggaagaacttacagatttttagcgagagaattaaatataaaattaaccccaacaaatccaattgattatgtgccaagatttgcatctgaacttggattgcctggggaagttgagtccaaagctatacagatattgcaacaagcggctgaaaaaggattaacaagcggtagaggccctactggtgttgctgctgcagcaatatatatagcaagcgttcttcttggctgtagaagaactcagagggaagttgctgaagttgctggagtgacagaagtaacaataagaaatagatacaaggaactaaccgagcatttggatattgatgtaactctgtagatattataaatagttagctaactttttgtgtagttaaaccttgataattaaaaatcagttaatttttgttaatttttacgtaatattaataatctggtggtttgtaatggggatattagacaaaatacagaaaaaatctgaaaaaattgaaaaagaaaaaaaatctgaaacagtgattccaagtgatactaaactcaaacctatagagccccatccaactattaataaaaaggcaacagttggaaatgatgaaaccatattagatacttacagtataaaaattgatgaaatagaaatggaagtagtaattaaaagagaggagggttatatttattatttagtccctgaaattgacaaaattaatatgtctctctcaaaacttacaaaagaccacttaaatcatataaaatctcaaatcagtgatttgggtctaatagaatatgaccaaataagagagtatttaacaaatttctccatgagatataatttggctattccgtatatcgactcattagcaaaattcttttatttagtaattggaaggcttggtttattagaagttccactaaatgatgatagattagaagaggttatggttaatggttacaatgttccagtttttgtatttcatagaaaacatcagatgtgtgaaacaaatatcgtgttagatagaaatgaagttgataggattattgaaagtattgcaaatttagttaatagaccaatagattcaagagttccaatgcttgatgctttcctaccagatggaagtagagtgaatgctaccacagcagatataactatgaacggagctacattaacaataagaaaattctcaaaaaatccattaactgtcatcgatttaataaactttggaactttggatatcgacactgccgcttttttatggcaagctgttgagggttactttggagcaaaacctgcaaacactttaatagctgggggaactggttctggaaaaacaactttattgaatgtcttatccctattctcaatgtacaatgaaagaatcataactattgaagacaccccagagttgcagattcctcataagcatgttataaagatggttacaagacctgcaagacctggaatgccagaatatgaagttacaatggatgatttaattaagaacgctctaagaatgagacctgataggatttttgttggagaggttagaggaaaagaagctcattcattgttagttgctatgaacactggacacgatggggctttagcttatgatgaacctatttatttatccgatgggaatataataaacattggagagtttgtggataaattctttaaaaaatacaaaaacagtataaaaaaagaagataatggatttgggtggatagatattggaaacgaaaacatatatatcaaaagtttcaataaattatcattaattattgaggataaaagaatattgagagtttggcgaaaaaaatattctggaaaattgattaaaataactaccaaaaacaggagagagattacactaacccacgaccatcctgtttatatatcaaagacaggagaagttcttgaaataaatgctgaaatggtaaaggtcggagattatatttacattccaaaaaataacactataaatttagatgaagtaattaaagtagaaaccgttgattataatggacacatatatgacctaacagttgaagataatcacacatatatcgctggaaaaaacgaaggttttgctgtctcaaactgttctggaacattacatgctaatagtgcagatgaagccattttaagattaacaagcccaccaatgaatgttccaaagattatgttaacagcattaaattttattataaatcagcaaaggattagaagagctggaaaaacgattaggaggattcttggaattgtagagattgtaaaaggtggtggtgaaggtcatgaatttgctaaaactaccctttacgaatacaatggtttaaaagatagtttagaaagaagaggaatttgtatgtgggaagaagaagtttgtgaaatagcggggattactaaagaggaattattaagagacagagaaaataggaaaaaggttttaagttacttgtacaaaaataatattagaaaacttgaaaatgtctctgattacataatgaggtaccaggtagatccagaaaaacttctgagatcgataagatgatattacctacttggtgaattaaatgaaaggaatttttgaaaaactaaagagaagaatcgatatactattatataagttgggtataagaccacttagtatagaaactttaaaagagttgaaggaatcaagaaaagaaagagaagttcttgaattctatgatgtttatatggaaccagaagagtttgttgatatagaaaaatatgaatttatactatatgaaggagatatcgttggtaaaacagcagaatcattgtcaaaaatatttaaaggtaatttatttccatcaagaaacgaacttagatatatgggagttaaggatgaagtagcctactttaaaaaggtagtaatctatatgattataacctttttggcattactttttatgggacttttggacaataacctacttcaaggatttgttaatggactgataggtgctgggattatattagtactatcgctattttatccaaaaattagattaatattatttaagggagagataaagcttcaaatcttatttacattaatatatatgatatcaatacttagagcaggagcgtctctaccagaagttttagaatctatttcaaaaagtagagagtacggagttgtagcatttgaagcaaagtctataattagggatgtcaatataggaggttacaacttagtagaggctcttgaaagagctaaaatgagaacaagaattcccatattaaaaaaattatacgaccagatgattgtaggttataacaaaggtaatctaccattacttttaggaaaattatatgaagacatagttagagagtctatggttaaattagattcatcaaaatttatgatacagaacttaggaaacttagcatttggtgttggattgatacttccttttactggaatgatactatcaactatgataggtaatcaaggattttcaggaatactgagcactatcaacctactactgttgaaaattggtccattattaacactaatatttggaatttttgttaaactaaaaatagaataaaaatgatttaatgtgatagcatgcccaaatacctgacaactctatataaaagaacaataaaaaggaatattatactctttaaaaaacttggtaaggattttgacgaaaaaaagtttatattattgttaataattatagctgcgatacctctcctaatatcatattatttacacttaaccctaaaaagtatgattatatttgtagttatatacgtgggagctgcattgttcattccatctattttatatgaaaataaaatagaaactcttgagaataacattccacaagctctttatattatgatattagccctcgaatctggaaggtccataaacgaagcattacttgaagttgttaaaagtaatataaaggaagttagcgatatatttagaaaagttttatacttaatggaaaaccaaaaattaagttttgaagagtctatgacaattgtatccaatttatatgattctaaagtattaaggatgttagcaagaattatgattgaaaacaggaaatacggaggagatttgtcagattctctaaaaatattagctaaaactcttgaagactttaaaatgtataagagacagttattgagtgttacagcaagtggtttagctattggttttattatattatgtggagttattccagctgttgccgcattattgggagcttatttaatagcagtatcaggcatgttaagtggagtagctccaatacccccagttaaaccagaagatatatcaaaaggatttgaaattgtgcaaatgggaacggcaattataggagctttatttgcaattccaatatttggtttaaaaatagggagaatgttcctaatttctgcagtaactatgacaatcggtgttttagcatattatacaatcttaaaattcgctccaggaatattctcataaatattattttaaaagattgtttatctcatcatttagcagaataattctcttaattgaaggatgatttttgcccaatcttttttcaaatttttttattacatcatctatctcaaccctcttagttccaaatatcaagttatcagcatgagctacaattttttcctccaatgttattggtagataatcctttggaggtaatccaagttctattgcctcctcctttgttattcctgccccaatatgcctctcagctattaatgcaagtttttcatcaaaacccaactctctcaaaatttcagcccctacaacaccatgttctatgccatgagttctactcctaccaatatcatgtaacaaacctcctaatctaacaagttcaacatcaacctcataacctttattttttatagccaaagctaattcataagcatactctgaaactgctaaacaatgttccaccacattctcagagcataagttttttaaaatagaaagggctttttcaaattccataatcccactccgcagacgggaatttttatataatcaccataaaaacattatttcaaaaaaggattgttctttaattcttcctttaaaaattttatttgctcctctaaatctttaattaattcactattgtcaaattcctgcaacatgtttccacaacctggacacgaaaagccataatccattgcctcttcaaatgtaaatctcacattacaatttggacagaagaaaaacatgttgtttttctcaaactccaacttcttctcaaggtctttaattaactcatttattttcttttttacaacataaggaagtttttcaagtgttggtaaccatgtgtaggaataccaattggtatcttcatctttccatctcttataatcaactaatcttgcatcatacaacttataaagcagttttctaactacattaagttttactccaagttctttagcaatctcttcttctgttgtctcgcccttctctaaaagaacatcaataacttcaaatcctttctcatctccttcaaatatattaaaaagaacttcctgaaccaaagggtcgtttagcatctcatatattctctctatcttcttttcttttctcatactctgcacactcctcataaacactgtttattattgatttaatgttttcttttgcaattactgtagctataggctctcctttctctataactgcatttttctttggaatatcatgtataaagtccctttttgatatattagcgataattttctctttagcaaacaatattctttttatatatacttttcttggtttaatctccttggcatacttattatttagcaaaaccattgccaaattttgagatgcactcatctctatggtctcataagttcctaaaatgcgaggatttatatcaacaatataaggaccattatctttaatcaaaaaatcaatgccactcattccttttaattcaaaagattctataacctcaccaaatatttcaacaaacttatttggtaaattaatatatggagttaaattcccagcatacattcccttaattataatttgtttgttaaaggttataaatgtattgcctataaagttggcactaaaacttttccctctaatatattcctgagcaataattgggaacttaatttcattaattatctcatcatcaaagttatttaattctatctttaaaatacttcctccactcccgtagataggctttaaaatgcaggttttaaattcttccaaaaatttatataattgagtcttattgtttattttcttagtttctggtatattaaaaccaagattttttaatttcttatatgttttatatttgttactgatttcatttatcttttttggcccattacctataacattatcccatcctggaattttcgaattttcgaattcaaaaacacctgaagttataaagatacaatcaacttcatcagctaatttattagctatttcaattaatttgttttcatcatagttttcttttaatcttccatgaactaaaggatttatcaaataatatttctcatcagcatttaaatcttctggggcgtagtaagagactgaatatacataaaatcctaattttttaagagaattaactacaggccttgtgttgatacctaaaaccaaagctttcaaattaccacctataaaatataaacagctaaataaaaagagcgtgaaattattcatagcttaaaagctctcttcttaattcccccaatgtagcaaccttttcagcaaatgcgtcatgtctatgaatactctccatatttatctgcctaattaaaaccttcgtctcatctggtaagtgtttaaatttctccactacccttttagccatctccctaacacaatcctcaacaaacttagggtttttatggctttgttcaacaacataagcttcatcagctctctttaatattccatgaatctcagcactcatggattttttaattatttctatgatatccataatctcaatatcatatccggtaggaacttccaatataattctaccaattcctctctgattatgagtggcaaatataacagaatccaatattttatcaatatcttcatcagaaaagcctttttcctttaagtttttaatacatatctcctttattaaattttgagcacatggacaagcagtgataccaacaacctcggccccaacaatctttgttaattcaatttcatcatccttctttattcccttagctccacccatgattttgtgaatctcctgggaatacttcccagatatagggcttttctccttagtcatgaaatcactaaccataaaaacctctgcctctgtggcatattcatgcttctcaaacaacctcttaactatctcctcacaaattgtctccatctcataactctccaactctaaagcctcatctattattccctctataacttcaggatttcttgacatgtgtattcctttctgagaactcggcaaattaacaaaaacctcaaacgtagataacaatattattggtcttttatttgttctctttaatctaacaagtttttttagatttgtaactccaactcttgttaatgatattttaacatctggctcaaaattttgaacatcacatctccaattcatcatcttcacctattaagacatccctaagttctttagatagtttataatatacgttgtttccttccctttctttataaatatatcccatctcatagatgtcagagagatgagttccaatagtacttggtgatttttttaaatattcagctaattgtgttaccgttgctgaacctccaagctcagccattgccctaacaatctctgattgggcaggagttaagtggtttagaatttgatgtcctacactaatgccaagagaatgcatagcctctttaacaaccttctcatctattttagttaaaccctttcttatagctattgatattgattcagagcatgtcattattatctttcttggaattccgtcacactcttcaacaattttatgaatagcctcttcagtaaacggctcaaactcctctgctccatcaatatgagcatcttccaatcttcttctaattaaatcataggactcatcttttgataaaggaggcatatttattatttttggaattctatcctttattggtggagatatctttgttaaatcatccatcaatgttggagaaccagccataaacgttaaaattccctcttcatacaaaaacgagtggaaaaattgtaataaacttaaacagctcttttttgcaaattggtcagcttcatcaattaaaattatacataacttatcaggacttttaacttcatttattagatattccaaatccctctcaatcctctcccttggatagtggataggaactttatccccatagttgtttaacttcctatacatatctaaaattctacttgaatgttccatgtaatcagattttatcgttccactcatggttatgatgttttcagttaatatattgtataagagctgtatcaaaaactgccttggtgttacctgagaggcagtcatctcaacaacccaatgtccctgcttttttgttgcatagtatatgatgtttagcattgaactcttccctatccccttagttccaactattgcagcgttagcaacactaccatgcaatgcagaacctaaaatttctccaatttcccttaactcgctaactctacctacaaaaaactttgtatttccccttattggcttttcagaaaatggattgtattttaattttaatttatgcatggtgcttgctatagagcttgcagatttttgtataaactctattgggtccatgtttccaccgcaataaaatataaattaatttatttaaattaattatctactaattatctacaatattttccattgatttcgaacttttgtcttaagaacgttatatagatttcgaaaaatcgaaagatagattgaatcaattattcttaaatttaaatgttttattataaagtttattaaaaatctcatgaatcaaacaataaaattaaaaaatctaatgaatcaaacaatatttcatatagaataagtgattattattttcagaaataaacttgaatgaaattaaatataatatatatattattctaatgaaataaagttaattttaattcttctcataggaattgcttcaaaatattaaaaataagatatcgtgaatcaaataatataaccaataaaaaactatgaatcaaagattatatgtaaattaacagtatattaaatctaagaattattagtaaaaaatagcatataacaacaaaataatagaaagagataaatattggtacaatatagaaacatactcaaagagacgttcttaaaatgttagtattactacacccaacacataggggttaaaacaatcccatgaatcaaaagttttataaacgagtatgtcaaatataattgagtatcaacaaaacaaaatcacaacaataatagttattaggaatactgggtgtaaatatggaaagattgccttatgaaatagtatcaactatatttagaaaggcgattttacattatgtgttaatacgtggcacaacctatccacaatcactcgcagaaaatttaaatatatcgaaaggtcttgcaagctcttttttgaggctatgttcggctctaaatataatgaagagagaaagagcgggacataaagttttatattcatttacatcaaaaggattggcgatattaaaaagattggctccagaaatattcgatttgagtttttcgagtgttttcgaacaattacctaaaaagaaaattgccactaagtattacccagtggataaaatagggtttgaaatcagctggaaagaggataaacttggaggaatagtattttcattctttgattccaatggagagcatttaggtgatgtttttagaagcaataaaggctattggtggtgtgttatctgtcagagtgatacatgcaaacacattgattatttgaaacggctctataaaacattgaaaaatcaagattaacgaatttcgaattttcgagttgcatgtatgtatatgaccaacagaatggacaactttttctgaaaaacgaattatcgcaaaattagagtaaaggatattatacactattttgtattataaacgtataacgttagagttttagagctaattatggtttttttatttttatttttttaaaataacattttttaacaatatttattggaaatattttacaataattaatattaaaatataaaataaaaaatttttactattttaacttatattgtgaaaaaaagtacaatagtataatagttgtgcttgcgatattcacaaccattttttaagttaggcgaagattttctgcatatacatacatgtaactcgaaaattcgaaaaccttttaagaaatttatatttaaattaagtttcttaaaatattaattatatgccaaaaaagaaaacaaagttttgtcataactttacacaatcaataaatattaatactgtcattaagttgagtatgaatactattaattattatatacttttcgaaaattcgaaaatctgtatatcccaaggtatgctatctaacaagaaaatagagaaccaatgcaaatagttatttttagattttttgaggagagttaataaaatatttctgttcaatcttattttaaatcttactttgcctttatgttttatttttgtcagtattcctaactcaaccaactcatctaaatatctgtatatggttgataatttgtaattaactttataagtaatatcttcaactttgaactttcttagttcaattataacttcaaccaattttcgatatttcgaatctactatatatggtaaaatcctaagccatggaatttttagctctctaagattttttatctctctttttgagtgtcttaatatcaaatatattgtttctaagtttccattggttatttttaggagatattcagccactctatcgcttatataataaccatgaacctttgcaaagtatcttatggttgcttttgtatttaaaatgccttctggaaaaatctccctaatctcttcatgacagtcaattggatatcttattacaacacttatactattttnccttaattctttaacaaagtttataaaactcttcctataatgccattttcttatatcatgaacatcaaagacaactattggattcaaaacctttaatagtgagattatctttccaacaactttttcaaattcccattttcttatatttctaaataaatcccctattcctctataccatgcctttttggctctataatatttatcgaactctatcttattgntcatatattctaagagatttttcagccagtttgcttttttatgatttttaaataagtagtatttatctttaatttgatagacaatcttggctatagccttttttaaatttggtgttgctaaaaccctaattatggctatattattaactacctcaaaatttccgttttcatctaattccaataaattccctctgtcagttggaattaaatacaatccatttaaaaactcttctggaactgcttttattattttcatctcttaaacctctttattatagctaaggagagatagtcattaaattcatcaaagttgatttcgtctaacttaccaattactactttttcatcttcaaaagttgccctctttaccaacccaattatataatcatctctattttttataactgatagcttctcatttaaattctttgtcttcataataattatagtgtcgaattcatcaatatatttttccaaatcctttccttgaggtaaaatgcagagtttttcatctccttcaactaatggaatatttaaagcagctgcagaggcaaatattgatgaaatgccattaactatctctacctcaacccctctttcttttaaaagtttccagacataggagaatgtgctatacaatgtagggtctccaatggttattatagctacttctccatcttcttttaaaaccttctctaaagcattttcccagtatttttttagcctctctttatctttaatcatggggaataaaagttcttcaatattcttcccatcaacataatcctttataatttcataggcaatagatttcttcccctttttagatactgggacaaagattttatctactttttttaaaacctctaatgcctttaatgttaatagctttttgtctccaacacctacaccaacaccataaaccttctttaccaatttattcaccttacgattttataaaattacaattaaaaacttttttagataacttactatataaatttagctaaattgacaataaatttttggtgacatgatgatatgggattggaatctatcgaaaccttctgaaagtattaaaaaacatagcggcacatgggataaaggcattgattacaaacaaacctataaaatgtttaaagaagatttgcagaaattgaaaaacaaggaattactttatgaagatgattacaagagaatagcttatcttataacttttttattccaattaaggaatggttgtaggatttgggaggctatagctgggatgataaacatagccatcaatatagacaatcttaattggaatgagaggataactgttaaagttaggactcagaagaggaaggattgggagtttagagagctgattataccaaaatgcattaaaaaagaggatattgaaatggttagggatgtttttttagacattaaaaaggagattgatgaaaagctaacaatggatgaaaagttaaaagcaaagaaaaagattgttaagagatttggagcttggctttataaaaattatggaattaatactcactccctgaggtatgcctatgttacttacttgggagaacatggcatcccagcacaagtcttagcaaaaataaccaagcataagaacataaactacattgaaacttacactcaaagcagactggcaaaagagattctaaaaaatattggggatttagatgattgagataaaaatatctaagattccaagatgggatgagattaataagattgtaaaactgagagaaaaagatttggttttgctaaaacttccaaagtctgtttatgaacatccaaaaatggcttataaactggaatatttaaagaaaaaaggcatttttatagaggttgagaatgcaaagagagggaggaagagaaaagttgatgatgaaactgttaaaaagattcatgaattaattattgagggctattctgttagagaaattggtaatattttaggcataggaaaatctaccgtttgggattatgctaaggattgtattaaagagttaaaacttgagagatttaaaaaattagtttgggagtatagggagtatttgattaataagggtaagtattctccaagtctgcaagttctatttttggagttggaggcaactgttgattatgatttggagaaggcgaagaagattttggaagatattataaaacatgttaaagaattctaataatactatatttttaatatatttatattcatatctttaagataatcgattttatgtatttttgtccgaaaatttttaaccaatgttagacttttgcacaaaagtccaacattaaacttaaaaaataaaaatatataaattaatttctaaaaacatcttcctccttaggtctaattaaatctcttcccttcccattaccaaaaggcacattagcccccctaattattacaactggaatgccctcatcagcctctcccataaccacatttgccatacttgccaactcatcagcaatggcaacttcagttgtttttaactccctaccaaacaaatccttttcccccttcctatcccataatgctaagattccactaactcctattgctattccaacagctcccttcctgaaaggtcttccaacactatctgatattattactccaactctctttccagttaatttttcaatctctttcctaatcttttcagcactttcatctggattttttggtagaatttttatgcctttgtatatgttactttcatcaactccactgttagcacaaacaaatccatgtttggtttctgttataatgaagttctttccaaccttaactatttctttagcctcatctaatataacttgcacaaccttcgggtcttttccagtttttttggctaattcaattgcttcttttgaagggattattttatccctatctataactccaccctctaattttgagattaatgtttctgctattacaataatatctccatcttcaattgggtattgagctatcaactcagataaatttatttgttctccacctttaaaaattgggagttctaagccaataacctctacctttcttttttctttaatcattctatcacatccctttttaagaaattatatataattacaataaatgttttaagttagaataaaaatagttttttatgtgatagtatggttaatgttgagagaatcagtatatcatttccaaaattccttttaaaagagattgatgaagttgttaaaaagaaaggttattcgagtagaagtgagttaattagggatgctgtaagaaagtatgtgttggaaaacaatccattaaataagaatgaaactgttagtgggattataatagttgtttataatcctacaaaggaagcattggaaaagatgagtaagttgtattttgaacataataaagttataaaatctttgaatcaggcttatgtaacaacatcttgcgggaaaaatgctaaagtagagatttttgttgttgaaggaaactctaaagatatttcaaagttttatgaagaaattgagaaaatcaatggaaagatttatgacaaggttattattttttagttttttatcataaattataaattataattaaaaatttgttggtgatattgtgacaaaggtagttattttaagatgtgatagtgcggcaaaaacgtgtccaggcgttggatgcatagcagtagcattaaacaaaaaaagatacattcaaagactatgagaatgttgagttattgtcagtaataacatgtgggggttgcccaggaaggttaggattgaatcagataaagcagttaatagggaagaatggggcagaggttgttcattttgcaacatgcatgactgcatttaaaccaaaatgtagatatgctgaaaagatgaaggaagagattgaaaagatgggagcaaaggttgttatgagttctcacttctaaattaatttttatttttatttttgcactatatacttatacatctgaatataaacctataaaagataataatattgtaggtaatacaaaatcaggatttatcataataattatatcaactatcttcaaagtgagtgatattaattacccctatctccaaaagaagaaggtcaaaaatatatttatacaatgaaaaagaaaagattttaatgtaaagcatctgtcaaatacattgtaaatgtttgcagatattaaaagtcttagggtgaaataatgaaatttgaaccaagacctacaaaaatgttctgcttccaatgtcaagaggcagcaaaaaatgaaggatgtacaataaaaggagtctgtggaaaagatgatgttgtggcaaacctccaagatttattgatttatactataaaaggtttatgctatgtctgtgataaaggcaattacttggatgatgaagttatggattacattccaaaagcattatttgtaacaataactaacgtcaattttgatgataaagatgtaataaattggataaagaaaggagtcgctttaagagaaaaaattatagaaaaaaataatttaaataaagaagaacttccatactgtgctacttgggcttacgaaactgatgaagatctaataaatttagccaatacaaaagaagttagcgtcttagcagaggataatgaagacataagatcattaaaagagcttataacttatggaattaaaggaataggagcttatctaagccatgccatgcatctcggctacaacaatgaggacattcataagtttataattaaagcattcactaaaatcgttgatagcaaagatgctgatgagttatttaatttagcaatggagacaggaaagtatgcagtagaaacgttagcattattagataaagcgaacactgaaacctatgggcatccagaaataacagaggttaatttgggagttagagacagaccaggaatattgattagtggtcacgacttaaaagatttagagcaattattagagcaaagtaaggatgcaggagttgatatctacacccactgtgagatgttgccagcccactactacccattctttaagaaatatgagcacttcgttggaaattatggaggttcatggccgttccaaagagaggaatttgagaaattcaacggtccaatagtgatgacgacaaactgtttagttccaccaaaggactcatataaagatagggtttatgtaaccaacgaagttggctatcctggcttaaagagaatcccagtaaaagaggatggaactaaggacttttcagaggttatagagcacgctaaaaaatgcaaaccaccaacaccactcgaaaatggtaagattgttggaggattcgctcataaccaagttttagcactggcagataaagtaattgaagcagttaaaagtggaaaaataaggaaattcgttgtaatggccggatgtgatggaaggcataaaacaagagagtattatactgaatttgctaaaaaactgcctaaagatactgttatattaacatgtggatgtgcaaaatatagatttattaaattagatttgggagacattgatggaattccaagagttttagatgctggacagtgtaatgatagctattcgttagttaaaattgcactggctttaaaagatgcatttggcttaaacgatgtaaatgaacttccaatcgcttataacatctcatggtatgagcaaaaggcagttactgtattattagctttgctttacttgggagttaagaatatagtattaggccctacactaccagcgttcttatcaccaaatgtgacaaaagttttagttgagaagtttggaatctcaacgatctcaacagttgatgaagatattaaaagattagttgggtaaatataatataaaatccaaaataacctttaatttttaattttatcttttattttttcattttttttattttatatattataattaattataagattgtaaatcagcaaaattgattaattgaattagcaaattaggttaaaattcagttgcatttataaaaaatattctttaaatatgtgttttatatgggtgattaaatgatagaaaaggtctatgagtttaaaagagacgctaaaacaaaggttgttgaaaaacttgtcaatactgaacatgtccagatcaaccatattgtcttaccaagaggagagcagatgccaaagcattattcaaactcttacgttcatttaataataattaaaggagagatgacactaacattagaagatcaagaaccacataattacaaagaaggaaatattgtgtatgttccgtttaatgtaaaaatgcttatccaaaacataaattctgatattttggaattttttgttgtaaaagcaccacatccaaagaaattgaatgcaccagaagacccaattaaatgtgaatagggtgaaattatggatgaaataaaagaatatttggctaaaatattagaaaataagataaaaatatcaatgattgcaaaatttaaatccgttgaagaatatgagggtagaatttttaaggatttatttgatgttgagatgaagaacttggagattttgtatgagaagtatctcatctatttcaatgaaaagccaaacataaaggcagaggttgatacaaacgcagatgttatagagattctaaaagaaaccattgagttggagaaatttttagctaaaaagttaggagttaattttggagttaggcaggcagttatccatgcgttatctgatgatgaaaggtttctgtatttcctaactaaaaagccctatttttaaaattatttttaattggtgaaaatatgcaaagctatataaaaaattttgagtcgtcatggtttgccgctgtaatgggaactggtgttttggcagtaacgagtctgttttattctgaatacttaccaatattaaaagatatatcatttttattgttttattttaatatactgctgttttttgtatttttaatgttgtggattttgagatgggtaaagtatccaaaaaatatgattgcagagttgaagcatccagttttaagttcatttagtcctactgtggctgtggctatgcttgttttgggtattgatttcatattaataaaaaataacctctttttagggaaaatcttctgggtttttggtgctattggcatgtttttattcagtttgatagttccgttttatatgtttaagtctgagagtataaagttagaccatgttaatccgggttggtatattccaccggttggtttgatagttattccaattgccgggagtttgataatgcctcatttaactggagtttggcatgaattaacggttcttattaattactttggttggggtgccgggttcttcttatatttagctttattagcagttgtgatttataggtttatactgcatcatcctctaccttcagcaatggctccaaccgtatggattaacttggggccaataggggctggaattgttgccttaataaacatggtgaataattccccattcataactataaaagaaccattctatatcttctccttcatattctggggctttggattatggtggagtttgatggctataatcatgactctctattacgttaaaaagctaaaactaccctacgcaatgtcatggtgggcattcatcttcccattaggggtttatattgcttcaacacacttggtttataaaatctttgggtttgagatagttgattacataggctttgggttatattggttgttgttcttcttttggatagtaactttaataaaaacgataaacaaagtttatagtggagagttattcaaagacaaaataaattaaggtgataggatgatagatgcccacactcacttagatgttaggagctttgaagatttggaaaaaatggcattgagtggaattgagacaattataacctgtgctcacgacccatataaaatgagtactccagaggtttatttagaccactgggataggttgattaatttagaggttaagaggggagagatggctggtgttgaagttaaagtagcagttggagttcatcctatggggtatccaaagaattgggaggttttaataaaaaaacttccagagtttttagataatgagaacgttgttgctattggagaaactggtttgcattatctaacagaggatgagaagaaccttttgagagagcagttatatttagctaaagattataatatgccaataattatccatacaccagaaaagaacaaaaaagaggcattaattgaaattttaaagattttagatgaagttaaaataaaagatagcttagttatgattgaccatataaataaggagacagttgatttaatcgatagggatgtttatgttggtttaactgtccaaccgtcaatgaagctaacccacgaagaagccgcagagataattaaaaattacaacaaaaaattcattttaagtagtgatttgggtagtttgaaggcggatatttatgcactaccaagaactaagttgtatatgaaaaatattggtgttgatgaggaaaagataattgcctcagtttataagaatgcgaaggggttttatagattataaataattatatatttaaattttgaaagtatgataacttttgtttttattgtttttagtaaaacctcaataattttaaaaacttttaatcgaaaggtttatatattatgagtgttaatacttgttcatagatataacacaaccgtgaattattaatttataatttttttatacaatccttgtgcataatattgacataggtgataagaatgataagaaagtttaaggttaaaggattgagaagtccttcattattaatagatatgattttaaatgacacagaggaggggattttagttgttgaaactgacggggaggagcagataaaagacattgagaagttattaaaaaaatacaacctaaagtatgaagttgatggaaatgttgttaaaatctacgttggagagattaaggcagataaaaccatcaatgttgttggagctacatgtccaggacctataatgatggtctctgacatgttatcaaaaatgaagaatggggagattttagaaatcatctgtggaaaaaattccttaactgatttaactgaaggattgaagggaatgggcaatgagataataaaagttgaagataaaggagacggaacttacagaatattggttaaaaagggagagaagaaagaagaaaaagcagcggtaacaaagattgatgaactcttcattataaacacaacaggaacaggaaatgctgaaaaggcttatgcaacattcatgatggcagatgttgccttaaaaatgaacttaaagccaacaatattcttaatgatggatggggcaagtttggctttaaaaggagaatgtgatagagttaagcatccagcatttccaaaattaggagatttagttagggatattttgagtaaaggggttaagatttatgtttgtgagttgagtgcagagtttagaggaattaatgagaaaaacttagaggaaggttttgagattgctggagcaccaacatttctaaactatctatcaaaaccaaatgttagaccagtttggttataaaaaagggtgagataatgaacgagataataagtttagtttctctatctgtaatatttggagcaatgctttcaggatttgccacatttagattgacaggaatgaggttaatgccacactttgcatctttaatgatagcttttatattaacattggcgtcattatttataagcaataatataataggttatttagcaatagcatttcaagtaataactcctttaacagtttgcccaactatatgcaatatattaaagacccagtttcaaaatactggaatatattcagctcatttagctttaatgggaatgatgtttatattggctttagggaatgttattttgttttaaaatataattggtatgtagtagaggtatttttgggattgatatcatgaacaaaaaaggaattgatagtttatttgtctctgctctttattacagcataaataaggcaatatatgatgttatgggggatggaggaaaggttttaggaaggagagcatcttatgagatgataaaactacttaaagatttgggttttataaaggaaaacatgagtaatgaggagattaaaaatttatttgtgaatacttttgggctatctgaggatttgaatattgttgaagaagataaaaaagtaatatttgaagttataaatcccacattagacctcttcctcaaaaaattaatggaagaaaacttaaagccatatgtatgtccatttatgtatttgctttcagaaatttatagtgtgagtaataactgcagattgatgctatcagatgtagttccagaaactgaagaaaaagtgaagttaatatttaagaaagtttaaaaatttttggtattaaacatcaattctttttataaaaattgtaggggagagtttatgagggcagtttttatttaccacaaaaataatcaaagaatggagaaattctataaaaaccttttgaatgaaccagatttttgtagaatttgtgatgattgttacaattgcagaggaaactggacttttaagaataatgtgaaaaatatcgttattgaggaagtttatgaggagtttgttgataacccttacgattaccttccagaactcccagagggggatatttgtatagctcaactacatgaagatttgttgtatgaacttcctctactgttaaaagaaaagggatataaagctttaattgttccttctgaaacaccacatgatttgtctttggcattgaggagagatttaaagagagtttgcagcaactataatattgagttcgaaaacccaaaacccttctgttcattggagaagaaagagggtaatgaatatataaataaatttattgactactttaagataggaaagccagaattggagatagaagttgaaaatggccttattaaagatgttaaggttaaaatctctgctccctgtggggaaacctattatatagccaaaagattgaaaggaaaggctatagatgatttaaaggaagagattgcaaatgcccaccacaactatccatgtttagccagtatggagatggataaagagttaggagacactattttacataaggctggttatattgcatttgaggtagtggaaaaagccctaaaaaaataaattttttattttcatggttgtgcaataattttcacaacttagtaaaatttatatatttgttttcttacactactatatgtagttaaaaagatacatatactataactacccttcaggtgaaaaaatgaaaaaactattaatggtaatattgggaattgcattgataggcatggcttatgcctttccaccatggatggcatatcaaactcagacaactgaaaatacagatataaatccagttgatattttaaaaactgcagaggttgttcagcacacaacaccgtttggttataacctctctcacttggagatagatgggaaaatagttggagttttatggaaagatgttgatttaagtaaattagaggttggagagccattcaatacaccatttggtgagaagtatcctctatactatgacagagaattggttggattcatctttacgaatcatcctgcctctcattacggatatgggatgagaggaggatatggatgtcattgccattgtggatgttgttgctggcaacaataataacaaaaaaataaaatatttatggtgtgacatatgccaatatgttgttatcatcatgctttcttttcaccatttccatttgcttttatttggattttctggatgatattttggataattcttttaattggaggaatcattatagtcctactaacacttaaatggttattaaaaagtaataacaaaaataacagtaaagcttatattccttttaaacaaaaataatatttgaggtgagaaaatgtggaaaaaactgatgttgctactgctaatggcgattccgttagtttcagcggtagcaatcccatcaatttctgcaacagatgtggttttagtaagtgacaactgtgcagaccaatgcactgccttagaggttgcagatgctttaaacgctactgtaataacaactgaatggggaatctacaacgaaagcttaattgatgaaatattagcactaaatccagataaagtaataattataggaggacctttggcagtagttgaaaattacacaactgccttagagaatgttggaataactgttgagagaattggaggaagtaatagatatgaaacaaacgctaatgtaaccttaagattccaaaatcaatttagatatgcttttggaaataatacaactgtctgcgtttgccatggatttgatgatattgctttaaatgaaacaatgggattaataaagaacggaacctgtttagtcttattaactaatggagtaaatttaagtgttgaaccacaaaaattgcaattaagaataaataaagttgaaattattgaaaatccaatttgtccattctgtaactattcaaaattgatgttgaaattgcaaaagaatgggttgaaaattgaaattaaacaaatcccaaaagttaaagttaagttaatgctacaaaatagaataagaataatggaaagaagaatcctcatgttgaagagaatgggtgttaatgtcactgacttagaggagaagttgaaagaagttgaacaattaatggaacagaatagatatcaggaagcatatagaataatggttcaacttcaggaggagcagatggttagggttaaattgcacttacatccaatgtggagtaaaatgaaaagaggtaaaatccaagaaaataaaaatgcttcacacatctatcatcaaaatataaataatcttactaatgaattaaatactagtagaggaggtattgggggaattaatgctccacacatatatcatcagagaataaacagtacaattcaataaatatttcatctcatttttttattttttattgtaaatggttatgtatgtgattgtctcaaccattaaaggtgataaatatgaaaaaaatagcgatgatattggtagtatttttagtaatatcttcactggtcttattctctggatgtgtaaatcagaatacagaaacagctcaaaatgttcaaactactcaaaataatcagcaaaatacccaagttggaaatgggcttggaaatggagcgggaaaaggaagatttgttgattcaaatgagatataaacgactcactaatgcttgaatatataagctcattaccaaaacaaccaataagtgaagaggaaaaagagggactcattgagatgagggaagaggagaaattagcgagagatgtttatttaacgctatataataaatggaaattacagatatttaagaacattgctgaaagtgagcaaacacacatggatgcagttaaatatctcttagaaaaatacaacatcccagacccagttaaaaatgatagtattggagtattttcaaacccaaaatttgaggaactatataaaaagttagttgagaaaggtgataaatcagaagttgatgcattaaaagttggagctactattgaagatttagatattgctgatttagaaaaatggataaacaagacagacaatgaggatataaaatttgtttatgaaaatttaatgaaaggttcaagaaaccacatgagggcatttgttagaatgcttaataattatggttctaattatactcctcaatacataagtaaggaagaatatgaagaaataataagcagttctacggagaggggaatgaataggtgaagaatatgaaaattataaataaaatagtagcaattcttctgcttttttccattttatccttatcttttgcatggaatgactgcccttatggaagggtaaattgcacctatccgggggagtgtggaagatacattgatacaaaccacaatggaatttgcgaccatagtgagccccctcccacaacaacaataaaaacaacaaacaacgaggaagagataaagaccagtaatgtgagtagtttagaattaacagaggaattgattaatgagtatgttggtatctcaggtaaagagttaaaatcctatacaataaaacaggtttgtgacaaatatggtataagtccaaaatgtttaaaggaaaagttgaatattaatgttccagatgatacaacctttggagagattaaggaagtttatggaatccctccaagtgttattaaaaaagctattgttgaatgtatgattgaagagggaaagattaaactaaatacaaccaatacaattgataataatagagatttaaataacaacaacagtggaaatgaaaaagtgggaaatacaatattggataagatagtatcctttttattctcaacaataaatttaagagatttgttgttcaaattttagctgtatatcagtataagttaagtctgctcaatacaggggtctgtccaacatgacgttataggcataactccatgttggacttgggaatcatcaaccttaactccctctgggttcattgggagcaaaccatctgtctttcgtatggaatgagaagtcataaggtgaaaaaactcaaagaaactataaaaaggagttgatggatgatggaagtaattaaagccatcgaatttaagtattattcagatgttgttgagttaatatatgattttaaagaaatggttaatttttgcattgataaggcaatggagctgggaattacttcttacgcaaaattaagaaaggcaatatataatgaatggaaggaaaaatggtatccaaaatatcatactcattactgtcactctgcttgtagagtagcaacatcaatttaaaaaattttagaaagaggaagaggaaaggtttaacaaaaaaggataagccagaagttaagaaagattttgtaaaacttgaggaaatgctgtttaaattcgagggggataaaataaaaattatcactgcaccaagaaaatttatcactataaatttagttgttagtgattatcagaaaaaatttattgaagagtggaaaaatggaaacttcaaaattggagaagtgattattaagaaagattctattataatcccattcaaaaaagttgttaatcctaaaaattttgaacatatcatgacaattgacatcaatgaaaagaatattacatactcaatttttgataaagatggaaacgtcattaagacaacccgtttagatgtgtataagttaaagagaattcatgagaatttctcaaaaaagagggagaaaatacaaaagaagctttccaataaaccaatgaagttaaaaactctcatggaaaaatattctggaagggaaaaaagaaaagttgaggattacttacacaaaatttcaaagtttctgatttcagaggcattaaaatacaatgtaaagatactaatggaggatttaacaaatatcagggaggcagttaataaaaaatcaaaaaattttaggagaagattaaacagatggaatttttccaaactccaattttttattgagtacaaggcaaagtgggatggtttagatgttgaatatgtaaatccctcaagaacgtccaaactctgcccaatatgtgggtgtaaattagacccgaatgggcagaggttgttaaaatgcaataattgtaatttagtatttgatagggatgttgttgctacatttaatttatttaagaaaagtcaggatgtggggagtttccgttcccccgaacgctccctgatgaagtcctcttattaaaagaggacagaacgggagaaccaatacaagagattacttaaaatctataaacacctacatagtggaggacggtggttgtaaatggataaaatccaaatattgaggaaaatctctcaaacattattttttatttattttgtatttttgacaagtttttgtttatgtttttttgggataattgagaagtttattttaaagggaagtgttggacagttgatagctaagttggttgttattgttgttttaactttaatattgggaagggttttttgcggatggatgtgcccattaggatttttatttgagctaatgtataaattaaggatgaagttatttatgaaaaagaaattaccaacagttaatgaggaagttcataacaagctgatatatttaagatatgttgttttaattctgtctttagttttaacttactatctttcaatctatgcattctgtcaagtctgtccaattggatttttaacgaatctttacggaacagttatatcccttataatattgattttctttttaagcctatccttctttgttccgatggcattttgtagatatttctgccctttaggagcgtttttatcaatattttcaataaaaccattctttcaattaaaaaccaataacaactgtgttaaatgcaaactttgtgagtttaaatgtccaatgcaaataaaaataactgaaaaacttgaccaaaaggaatgtataagatgctttgaatgtaaaagtagctgtaaaaaagatgccttgtccttttcttatgcattcaaaaagagaagttaataaaaacttctattttttattaacaattatacaaattttttattagatttatctaatttttatcctcctatttttaaaatatctggctaaaaatctttttatattttggattccagagtttatattataaagtttgataattggggttttatggtgaatcttatgaataaaatacaaatattgaggaaaatatctcaaacattattttttgtgagagctttaatagttactggtttttatttgagtattgtaggatttattaagagatttattataggagataggatattagctactataataacaaaaatcatcgctatagtattggcgtttattgctggaagggttttttgtggatggatgtgtccatttggatttttatttaatttagtttatgagttgagggtaaaactctttaaattaaaaaaactaccaacagttgatgagaaaattcacaataaattaatttattttaagtatgttgtgctaattttagtggttttagcatacctatctggagttaaaatctctggatatacattggcatatctgctgttggctttatttttagttttaggatttatttatccaatgttcttctgcagatatgtttgtccagtggggtctttgttgagtatatttgcgagattctcaatctttaaactgaaacttgatgaaaataaatgtgtaggttgtagattgtgtgaaagaaaatgtccaatgcagataaaaataacagaaaaaatagaccagatggagtgtataagatgttttgaatgcatgagtgtatgtaaaaaaggagcattatctttttcagcttttactaaaaatactaaaaaagaataattccaatatacacatatttgaaaaataaaattaaaacaatttatataaatctttaagtaaattttatttatattgtgaaatagtattttcaaatttagcagaggtatttaaatagatatgttgaaattcgaatagttaagttcttatactacttacacaataaaataaataactgataataaaataactaataactacaaatataattaaaggtgaaaaaatatgaaagcagacgcagcaaaatagctgatggtgtatattgggtgggggttttagactgggacataagaatgtatcacggctacacattaaaaggaacaacatacaatgcctatttagtctttggagatgaaaaagttgctttaatagacaacacatacccaggaacctccgctcaaatgtgggggaggataaaagatgcatttgaaaaagaggggagggaatttaaaattgatgtaatcgttcaaaaccacgtagaaaaagaccacagtggagctctccctgaaatacacaaaaaattcccagatgcaccaatatactgtactgaggtagctgttgagggacttaaaaagcactatccatcattaaaagacgctcaatttaaggttgttcatacaggagatacagttgatttaggaggaaagacattaacattcttagaagctcctctattacactggccagatagtatgtttaccttctacaacgaagggggaattttattctcaaacgatgcatttggacagcatctctgcttcccagcacacaagagatttgataaagatattccagagtatgtgttaatggatgcaaaccagaagttttatgctaatttaattactccactgtcaaagcttgtattaaagaaatttgaggaagttattcagttgggattattagaaaagataaaaatgattgccccatcacacgggcagatatggacagacccaatgaaagttattaaggcatatcaagactttgctactggtaaagcagctaaggataaggcagttatcgtttatgatactatgcactactcaacacaaaagatggctcatgcatttgcagagggtttaatgagtgagggaattgatgttgtaatgtatttcttacactacgatgagagaagtgagattgttaaagacatcttagatgctaaggcagttctctttggaattccaacaatctatgatgagccatatccatcaattggagatatcatatactacttgagaggattgaaatttaacagaacaggatttaagagattggcggttacttttggttcaatggggggagaaggtggagcagttgctaagattgctgaagacttggcgaaatgtggatttgaagttattaatcaatatgaactctactatgtcccaacagaggatgaattaacaaactgctacaatatgggtaaagaattggctaagagaattaaagagatgaagattgaatgaatttaatcctttttttacttttttatttttttaagaatatatttgtatatgtaaattaatagtattaggataagtaatatatatataagaaaaattagaagatatgagtaataaaatatcgatattggcaaaaattttagttattaattaaatatatgtcgaaattcgtataattaataatatataccgtaatagcataaatttatttgaatggtttgtgagccttattaaaaatcttagttcaaaatatttacttaaaatttattttatgtgtggtgagattatgaaaaaagagataatcaaatggagtaaagattttgaaacgggaattaaagcatttgatgatgagcataaaattttggttaaaacacttaacgatatttacaacctactaaacgaaggaaaaagagacgaagcaaaagaacttttaaagagaagggttgttaattatgctgcaaagcattttaagcatgaagaggaagttatggagaaatatggttatccagacttagaaaggcatagaaaaactcatgagatttttgttaaaacagttatagaaaagttacttccaaagatcgaagaaggatcagaaaatgattttaggagtgctctatctttcttagtgggatggctcacaatgcacatagcaaaaccagataaaaaatacggagagtggtttaaagagaaaggtattgttatcgaggatgaagcagttaaaattgattaaattttgaattaattcatcacaaatgtatcgaatttcgaaccattaatattatataatcgtgattgtttattttataatgtaataattaaaaagttaaaaaggtgaaagcatggagttggacttaataaatgaacacaagataggagtaacaaaaggaacagagttagaaaaagaagttcaagcaaattttgaaggagagtgcaaagaggttggattatacttagctatggcaagacaagctcagagggaggggttaccagaggttgctgaagttttaataagaattgctatggaagaggctcaacacgctgcacactttgctgaaatgaacggtttaatttcagaaaacttaaaagaaaacattgaaatgatgttaaaaggagaatgtatggcaaacaaagagaaaaaagctgctgcaacaaaggcaaaagaattgggtatagacccagctcatgacttctttgatgaatcaagtagggatgaagcaagacacgcaaagatgttaaaaggaatcttagacagatacttcaaataaatttaattaaaaatttttatttaatttttattttttaattctgtattgaatattgcaaacaaattgatattctgggtattataatattattatatgttttatcactttatatttactaattttttaatttgttttatttattgttcaacatacttaatatttatgatgtttgattaatgtttaaactgttatttgccataaaaaggtgaaaaatatgcgagttgagcttaaaacaaaagatatgaaggaattttataaaatattcagtgaaagtgaatttataataaccgatgacagtaaattaataaatgaaacagtaaattatttaaagaaaaaatataaaaacagtactacaaagaaaaaattaattccattagatttatttaaagctattgttctgataatgatgaaaaagatcaaagaattagacagcgagataaccttatatgatattggttatgaatttgggaaacacctaaatccaaaaagatacagcgatttaaaaaaatttttcaaagaaaataacttaggaactctaaaagtggatagcagaaaaccactggttttaaaagttgagaactgttctttttgcgaagatctaagttttgaagagccaatctgttattttgatgctggattaatagcaggagcttacgaatgcatattaaaaaagccagttgttgttgatgaaataaaatgcatggcaaggggagatgatgcttgctattttaaagttgaagtggtaaaataaacaaaattttctttctattttcggaggaaatatctttttctcattatttctttttcaattcccattttattattttacttaaatactacaatgcgattatcgaactttacatttaaaatattgtaataaagtataatggaaaacgatatatagtttcaaataaaaacataaaaatgacaaaaatagtcccaactgactaattgatcaggtgaattaaaatggtgatctacgctcaaaaagatattagcaacgattttattaaagaaattataaagacaggggaaattcttggagaaggacatgtttcctcttttaaagcatgctatcaatgtggaacctgcactgggagctgtccaagcggaagaataactgcttttagaacaagaaaattaataagatacgctcaatttggaatgaaatccgcaataatagacagtgaagacctgtggatgtgcacaacctgctatgaatgttatgaaagatgtccaagaacagttaagataactgatataataaaagttttaagaaatatcgctgcaagagaaggaaaaatggctgaggcgcataaaaaaactgccttatatgtttttaaaacaggacatgctgttccaatcaatgaccaaataaaaaaagcaagaaaagaaatcggtttaactgaaattcctccaacaactcacaagtatcctgatgccttagaagtggttagagggattatgaaagacctaagattttgtgatatggttggaatctgcacagaaacaatgcaattaaaaccagtggaatggaaagacatgtcagaataagaaataaaaaccaaaaataaaaataaaagtaaagaaaggtgttttaatatggaatttgtgttctttttgggatgtattgctccaaacagatacccaggcattgaaaaagccacatatataacaatggagaaacttggaataaaattacacccctttgaaaaggcatcttgctgtccagctccaggggttttcggttcttttgacttaaaaacttggttaaccttagcagcgagaaatttatgtatggcagaggaagttgaaatggacatcttaaccatctgtaatggatgttatggctctctatatgaagccaatcatctactaaaagaaaacgaaaaagcaagaaaaatggtaaatgaaatactctccaagtatggattagagtataaaggaaaagttagagttagacacttacctgaggttttatactacgatttaggagttgataggattaaagaagagataacaaacccattaaatgtaaatgtagcagttcattatggctgtcattatttaaaaccaacggatattaaaaaattggaaagttcagaaagaccgagatcttttgatgaacttgtagaggcacttggagcagtgtcagtcaattataaagataaaaatatgtgttgtggagctggaggaggagtcagagcaagaaatttagatgttgccttaaaaatgactaaaacaaaattggaaaatataaaagaagcaaaagccgattgcataaccgaagtttgtccattctgccacttgcaatttgacagagggcaagtagagataaaggaaaagtttggagaggaatataatattcctgtgatacactactcccaattacttgggcttgcaatgggaatgtccccgaaagacgttgctttggacttacactttattccaacagatgagtttatcaaaaaaatagataggcattaaaatttctatttaaaaaatttagaaagttatatatactatctaaaatcaaaaatataatatatgaattaggtagtaaaaccactcaaaaaataacttataaagaacttaaacgataaaaaggtgaaaaaatgaagaatgaagtattttttggggagggaatgaaagtagttaaggagaaatacccagatctctatgacattatagtgaaattaaatgacactgtctttactggaaaaacactggattataaaactcagaaattgattgcaataggaattgttgcatcaagatgtgatgaggtagcgatagaaaaacagatgaaaagtgcaatgaaagaactcggaattacaaaagaagagattgcagatgttttgagagttgttttattaacaagtggaatgcctgctttcacaaaagcaatgaagatattagaaaaactctaaacttatagataatcttttatttattaatttaatttatttcatacccttatactctacttaacttagtttgattactatgtataacgaaaaatcgtggggacaatatgacacactactgcggaataaaccgaatgaaagaaggaactgattttgaaaagaaacatactccatttattgagtgtaaagacagagttaaagcaaacgattattttgaagtaaaaatttcaactggaattccacatcctatggaagataatcactttatacattggatcgagttatatatgggagatctttatttagcaagagttgattttacccaatttatgaaaccagaggttaagttaatggtaaaagccccgtcaaaagaacatgagaaatttatattaagggcattaatgagatgcaatcttcacggggtctgggaatacgaaaaagagattctgcttgaataaaatcccatttttataaagtaaaaaataataaactaaaaactaataacttgcatataaaaaatcacaaatacgataatcgtctttaatttcattatattatgcgaaatttaagtgattaatgatatatacctctaactgactaagataaataatgacaaaaatagcacaaaggtgatagaaatggcaaggtatcaatgcatgtgtggatgggtgtatgatgaagacaaaggtgagccgtcacaaaacatcccaccaggaacaaaatttgaagatcttccagatacttttagatgtcctcagtgcggattaggaaaaaacgctttcagaaaaatcgattaattaaataaaacgcgatgtgaagtatatgtctatatgtaagtatgtaaatagttcatgtaaaggtgtgattaatgatctcggttaaagatgttgtaaattacaatccagaagaatacaaatttaaaagtagagaaattccctcagatttacttgcaattataatatacgcatatatgcagaaggttaaagaccttggatcagacacaaccctgtatgaaattggttatgaagttggaagattagtgtctccaaaaagttatgaagatattaagaagttttttgaggccaataatattggttatattgagattaaagaaaaagataacggagaagtggagataaaagtaaaggactgtatattttgtagaactcaaaagtcagaagaaccaatgtgtgattttgaagcaggactgattgctgggttcttagaatcaataaaaaataaaaaatatttcgttaaagagatgtattgccaagcacaaggttatgatgcttgtgtatttattgctaaacctctccataactaaaaagtcagtttattaaaggtgattattgatgataacaacaaaccatccattatatgaagcattaagagacatccaggagtttaaactaagattagtagaatattttaaagataaggacgtttttccaataaaaaataaggttgagttggcagaggcattgccttgtgggatttcacttccatgtggggaaattgaagcagcagaattggttaaattgctaactgacaatgattttccaataaaagatccagaggatttggcaatgaaattagcaaataaatgtccaataaagcaataaaataataaaattattttaattaaactttttggtgagacaatgccttggtggaaatgctcaaattgcggctatgtgtttgaggcagagaaacctccagaaagatgtccaaattgtggggaaaaatgtacgttctatgatgtttcttgctacactcccgaatgtgggtttaaaggatatgacccaaaattagtggcaaggactccaaatcaagaaagcaaaatgtaaaagaaaagcaaatataaaataaaaaccaataaaacttaaataaacaaaagataaaataaaaaggaggggagaaaaatgtgtgaaggaaaaatgccagttattggtgagaaattcccagaagtagaggttaaaacaacccatggagctattaaattaccagattattatgtagagaaaggaaagtggtttgttttattcagccatcctgctgactttactccggtttgcacaacagagttcgtaggatttcaaaagagatacgatgaatttaggaaactaaatactgagttgattggattaagtatagatcaagtttttagccacttaaaatgggtcgagtggataaaagaaaaattgaatgtagaaattgagtttccaattatagcggatgatagaggagagttagcagagaaattgggaatgataagcccatacaaaggaaacaatacagttagggctgtgtttgttgtagataataaagggataattagggctatcatctactatccgcaagaagttggtagaaacttggatgagatcgttagattagttaaagctctccaagtttcagatgaaaaaggagtggctatgccagcgaattggcctgaaaatgatttaattggagataaagttattatacctcctgcatcatcagtggaggagataaagcaaagaaaagaggcatgtgagaaaggggagattgagtgcttagattggtggttctgttataaaaagttagattaaaactttcaatgaaattactatatatttaacacatattataaatttctaaatctttttaattaattgtaattgttttttgaggtggaaatatggtagaattaaagattgcctgtaaattggacggaagttgtgaaaaaccaagatatagaaaatacaagtgcaaagtatgtggatgggtttatgaccctctaaaaggagatccaagtcaaaatatacctccaaaaacaccttttgaggaactcccagatacatggatatgcccagtttgtagaggtaaagtaggaaaagaatcattcgagccgttagatgagtgggtagagtttgatgaataattaaaaattttattcaacatatttaacatttcattattattgattaacaacttttttgtgataaatatgaaagagacactaaaaaacttaacaaaagcatatataggagagagtttagcaaggaatagatatacctgttatgcaaagattgcaaaacaagagggatatgagcagatagctgagatatttttattaactgctgaaaatgagagagagcatgccaagtggctttattacttaataaccgaactaaaaaagaaatataacattgatgataaagctataaaagttgatggtgtagaagttccaattgttttaggaaatactgctgaaaacttaaaagcatcgattgaaggagagcattttgagcacacagagatgtatccaaagtttgctgacattgctgaaaaagaaggacttaaagagattgcagataggttgagagctatagggatagctgaaaagcatcatgaagagaggtttaaaaaactgctaaaggaagttgaagaaggaacggtatttaaaaaagataaaccagttgaatgggtttgtagaaaatgcggttttgttcatcttggaaaagaaccaccagagaagtgtccttcttgcagtcatccaaggaaatactttgaagttaaatgtgaaaaatattaaatttaattaatttaatcaattaaaacaaattataaatgaggtgggggtttatgaaagttgccttcttaatattttcttactttcacaaaaatcagccaaatatgcccgttatgatgcatacattactatttgcaaatgaattaaaagaaaagggagatgaagtaaagattatattggaaggagaagcagttttatgggcaaaagatctgttaagtgaaaatcatccattaaaaagccactttgaaaaagtaaaagatgattttgttgtatgtgaagcatgtgcaagtatgtttaatgttaaagaagaaattaaaggcaaattaaaattagaaaatgatttatttggacatgtaagcttaaagaaatatttagatggtggatatagaataattgagctctaattactaatctgtttttatatttatcctatctatatttattctatatttatttttatattatttaccactactcaaaaggtgatcttaatggtattagaaataaaaaatggaatatactgggttggagtgattgattgggaaattagagattttcatggctatggaactccctacggatcaacctataactcttatttgataaaagataagaaaaatgttttaatagacactgcaaaggattacatgttcaatgaacttatttatggcatatcaaaatttatagatcccaaagatctcgattatattatagttaatcacgtagaaaaagaccacagtggttgtgttgataaattggttgagatcagcaatgccacaataataactaatgaaaagggaaaggagcatttatctctctactacgatacaaaagattgggattttatcattgtagatactggagatgagataaacataggagacagaactctaaagttcataagaactccaatgctccactggccagataatatgctaacttactgtaaagaagagaaaattttattctcaaacgatgcatttggacagcatatagcaagttctgagagatttgattacgagataggagaaggaatttttgaacatgcaaaggattatttcgctaatatattgatgccctataaaatgcttattcctgatgcaataaaagccgttaaaaacttagatattgagcttatttgcccttctcatggagtaatttggaaggaatacataaacgaaataattgaaaaatataacgaatgggcaatgaacaaaacaaagaataaggcagttattgtctatgatacaatgtataactcgaccaaaaaaatggctcatgcgattgctgaaggtttaatggagaaaggagtagaagtaaaaatttatagagtttgtgaaacctctctaagtagaataatgacagaaatcttagatgcaaagtatgttttagttggctcaccaactgtaaatagaaatctctacccagaagttggtaagttccttgcatacatggattgcattagaccactcgacaagatcggtgttgcctttggttcttatggttggatggaatgcgcaactgaaaaaattaaagagatattcaaaaacctgggctttaagatagttgatgatgaatgtttaacagtaagatttgctccaaaagaggaacatctaaaaaaatgttatgaatttggtaaaagattagcagatattggcttctgatatatatttttattatttaaattttatttttttaaggtggaataatgaaagtctttgggataagtggaagtccaagattgcaagggactcattttgcagtaaattatgctttaaattatttgaaagagaaaggggcagaggtgagatatttttcagttagtagaaagaagataaacttctgtcttcactgtgattactgtataaagaaaaaagagggatgcatacataaggatgatatggaagaggtttatgaaaaccttatttgggctgatggagtgataataggaactccagtttatcaggggaatgtaacagggcagctaaagacattgatggatagatgcagagctatactggcaaaaaatccaaaggttttgaggggtagagttggaatggctattgctgttggtggagatagaaatggggggcaggagattgctttaagaactattcatgacttttttataataaatgaaatgattcctgtgggagggggttcttttggagctaatttaggggctacattttggtctaaggatagagggaagaaaggagttgaggaggatgaggagggattgagagttttaagaaagacacttaatagattttatgaggttttaaaagaaaagagggggttataaagaggggtagtatgctaaaaattgcatggggaataaccggatgtggagataaactgccagaagttgttgaaataatgaaaaagctaaaaaataaatataatttggatgtagatatctatctctcaaaaaatgcaaagattgttgtaaagtggtataaactctggcaggttttggaggatgagttttatgatttaagggttgaggttaatgcaaacgctccattcttagttgggaagttgcaaactggaaaatatgatttgtttttagtagctccagcaacggcaaacacaactgcaaaaatagcttatggtattgccgatactttaataactaattcagttgctcaagcaatgaaggcaaaagtaccagtttatatctttccaccagataacaaaaaaggaactgtagagacaattctgccagggaataagaaattaaccctatatatgagagatgttgatgttgaaaatgttgagagacttagaagaatggagggaattgaggttttagataaaccagaagatatagagaaggttattttaaagcacatagaggtgaaaaaacagcaataagctatctatttttataatattttagcaaatcaaacacacttaaagttccaacaacctcatctctatcattaataacagggtaggcaatgtcttcgttttttattatctcatctattaattcatcagttacttcatcattctcttttaaaatctttatctcatcaataagtaacattaaatcctctatttttgaatgcttacagcctataagcaaatctaaggcagtaatccatccaactaattttccatcttctataactggagcataatttttcttttctttgtagagagtttgaacaacttctcctccaatatcatttggggagatttttataaaatctttgttcataacttctttaactttcattatcatcatctccgtttgatattactgctcaataattctataattattttttcatgcaaaaattttgctattgtattttataatttattaattcaaatcttctattttaatgtgaatatcgttttcattgcaaaacttaaagacgatttccaaaccgttaatgttatttattcgttaatatattaatgattatcgtaaaacaagttaaaaatatgtttggtgataggtatgaaaaactgcatcgctgctattccagaagttaaggaaatggttgaaaaggcaaagttaaagggtatagaaactcctcacacaagattcccaaatcaattcccaaagtgtccttacgggttaaaaggggtttattgcatattatgtgctaatggaccttgtagaataacagaaaaaactccttacggtgtttgtggagcaacagcagatgttattgtagcaagaaacctctgcagagcggttgctgctggaacatcatgttatgtccattgtgctgaaaacgctgcaagagctttattatcagcaggtaaaggagaaggaagctatgaaataagaaacgagaaaaaattaaagtttttagcgaaaaaacttggctttgatgcaaataaagatgctaagcagttggctgttgaagttgctgagttcatattagatgatatgtacaaaccaagatgggagaagagtgaattagttccaaaactctgtccagagaagagattagaagtatttgagaagttagatatccttccaggaggggctaagggagagattgttgatgcattaacaaagacttcaacaaacttaaacagcaatccaatggacttattggttcactgccttagattaggattgcacgcaggatttacagggcttttaatgacttgctggttaaacgacatcttatttggttcaccaaagattacagtagttgagaatggattcagttcagttaagccaaacaacgttaatatcatgattactggacaccagcacgctttaatccagccattatgtgaggctgcaatggaggaagacttaataaaaatggcaaaagaagctggagctgatgagattaagattattggagctacatgtaacggacaagatatggaaacaagaattgcccacttaccagaaagcttcgttggttacatagcaaacaacttcacaacagagccattggttgcaactggtttaattgatgctgttgtctctgaattcaactgtacattccacggattgaaatttgtcgctgaaaaaactaagacaaaattaatctgtattgatgacatggcttacgttgagggagctgaatacatcccatgggagccagagaatgctaaagaaaaggcaagagagataattaagaaagcaattgaggcattcaaagagagaaaaggaatgcagaaggattactacgatgagaaagttaaatcagttgttggagttggagaggaatcattggttgagttcttaggaggaagtgtcaagccattaattgaattgattgcaagtggtaaaatcaaaggggttgttggagtcgttggatgttcaaacttggcaagtggaggacacgacaacataattgtcacattaacaaaagagctcattaaaagagatatcttagtcttagcaggaggttgtgtaaacagcccattgaaacacgcaggtctctttgaccctgcaagtgctgagttagctggagagaacttaaaagaagtctgtaagagcttaggaatcccaccagtcttaaacttcggagcatgtttgagtattgcaagaattgagcaggttgcagttgcaattgctgaagagttgggagttgatattccagatttaccagttgctgcctcagcaccacagtggttggaagagcaggcattggcagatgcaacctacgcagttgatatgggctttactgtccatgtttcaccagttccattcgttactggcagtgagttagtaacaaaggttttaactgaagcagttgagggcttaacagggggtaaattaatcccagaaccaaacccatacaaggcagctgatttattggagcaaacaatcatggagaagaggaaaaaacttggaatctaattaaattctttttaaacttttaaaacattttaaaaaggtggaattatgaaaattagagggtttgaaagctcaatgatggggaaagatatagattttattcccccagctatgacaaggttatgctgtttaaatgaaatctcccatgctttagcaggagttatggctgttgagaaagcttataacataacagttccaaatgaagggcagtatttgagggagattgcaagattgggggagattgttgaagtagatgcaattaagttgagagaatttaaaaatacagatgatttagcagatattggaaacaaaataaaatctgtgttaggaaaaaaggctaaatatttggctgttggtggagttttagaaaatataagtgataaaagaaaagaaaaattaattaatttggcaaaagagggattaaacttagttgataaagattttgttaagttagttgatgagagaaaggcaaagattccattgccagatgttgagttgattgatgcttataactttgatgctaataaagtggaaacaaacggcttaccaaaaacagccctttatgatggaaaggtagtttatagtgggtctttggcaagaatgtataaggagggcttaataaattcaaaaaacttatgggatgtgttatcttcaagaatgattgagatagaattctgcttaaataaaattatagaactcttaaacaaattaaaattaacacacccatacatggagccaattataaaagatggaaaggcaattggggaggctgttatagaaggaggagagggaatcgtttatcacaaagttgagttacttggaagagagattttggattacacaatattaacaagtgagaacttcaacaaagcagttttggatagtgtagataatgatgaagcaaaaagaatcattcagctctgtgaaagatgctactatttataagctaattagataactacgaaaataggggataatttgaactaatggacattaattagggttgaaagccctaacttaatggacacgttttggtcaagcttttactaaaaggttgagggtgattttatgaccggatgcggttcttgtggtaagattatcaaaaacattgaaaagaagtattataaccaattaaaagaaaaggacattgttttggttggaggagctgttaatttggatgatgaggaagaagttaaaaaaataatggaaattagaaaaaactcaaaagtattgatagcagttggtagctgtgctgtaagtgggggtttccaaagaatgcttattggtttagagaatggcttcccacaaagatttgttagaataggagatgttgttaaggtagattatgcaataattggctgcccaccagatgaagaagaggttgaaagaatagttaaggcagttattgaaaaagacaaggaaatcgttgattcatacttaatactaaaaccttatgaagttattgctggaaaaccaattattgatgcctatatgaaagttaatgacgttttattaacttcaaataaagagttatgtttaggatgtgatgataagccaataaatgatgagttctgtactggttgtggaacatgcgttgctaagtgtccagcaaacgctttaacaattgatgaaaagccaaaggtcaatataagcaagtgtattaaatgcggaacttgcttcttcaactgtataagggtaaaggaagcattattgccgtaaatttaaaattctaagaggcattgccgagcgtagcgaggcaatgcatccgtggtatcccaataggaggtatcctcctatggtgtaggaacttgcttcttcaactgtataagggtaaaagaagctttataattaatttttgcataatttaaaagtttgaggtgatgtataatgaaatatctttcagcaaaatcaaaactaaatattgatgcccaagatggtggatttacaacaacattgttaagttactgcttagaaaatggtatattggatgcagtagtggttgttggagataagaattggaagccagtagcttacttagctactacaccaactgaattactaaaatcaacaaaaagcaaatactcaatatcaccaaacaacaagttgttggagtatgcaacagaaaactatgataaagttggattggttggtttgccttgccatatattgggaggattgcagtttgatttaactttaaaggttggtttattctgcactaaaaacttctactatgatacaataaaaagcattataaaggagagatttggagttaatattgatgaagtagctaaaatgaacattacaaaaggaaaatttgtcgttgaaacactgaagaaaaaaggctttgctggaactgaaaaagttgtttatgaaattccaataaaagagattgaaaaactctgcaacttaggatgtagggtttgcactgacttctcagctaaatacgcagatgtatcagttggaagtgttggaagtgaagatggctggaacacagtaattgttagaaacaagatggttgaggacataataaatgagatggctgagaagggattaattgaagttaaagaaacagttgatattaaagcaattgaaaaattggaaaacattaagaagaaaaacgaagagattaacaaatgctctgcatactttgctgtgtgtccagctctgttttaaaatataatgcttttttatttttgaaatctaaccgtaagagatatgaatttagtttttaataaaatttttctgttttttataactttagtggtgatatgatgctaattaaaaagattgaagaattaaaaaactcagaaattaaagatattattgacaaaagaatccaggaatttaaatcttttaaaaataaatctaatgaggagtggtttaaagagctgtgtttttgcatcttaacagctaattttacagctgaaggaggaataagaattcagaaagaaataggagatgggtttttaacactcccaagagaagagttagaagagaaattaaaaaatttaggtcacagattctatagaaagagagcagagtatattgttttagcaaggagatttaaaaacattaaagatattgttgagagttttgaaaacgagaaagtagcaagagagtttttagtaagaaacataaaggggattggatataaagaggcgagccactttttgaggaatgttggttatgatgatgttgctataatagataggcatatattgagggaactctatgaaaacaactacattgatgagattccaaagacattgagtaggagaaaatacttagagattgaaaatatattgagagacattggagaagaggttaatttaaaactctctgaattggatttgtatatctggtatttaaggacaggaaaagttttaaaataaaaacaataagtttatttcatttgctctaaaataattgctgggcaaatcttttttattccttcaatctttccaattttgttaaatattaagtcagagaactcttttccatctttagcccagatttctgtcataatcatgtggtctcctgttgatgtaaataccttcttaacttctggaaacttacagagttcctttgcaacatttaaaaatttatcaggctctgtatcaaatcctgttaaggcaacgacattataaccaatctttgatggatctattattgcagtatagcccttaataactccttcctcttccaattttttgaccctctttcttatggagctttcacttgttcctaactcccttgctatatctgtgtatgattttcttccatctctcataagaatttcgataatttttaggtctttttcgtccataatatcaccgaatttcggatgattaataatattaatataacctaacaattatagttcattgcaaaatataaggtataaaaaggaattataatgaacgccttctataagaaggcgttcaattttcatatttaattttaatcattttgcaatgaactatatgtatttagttgaaatatataaaaattttggaggaagaaaatggcggttgagataattgtagatagggagaaatgcattggatgtggaagatgttatgatgtatgtccaaaagggccgttaatatggacaaaagatgaaaacggaaaatactatgcctatgatgtagaatactgccacaactgtaagttttgtgctggtagatgccctacaaatgcaatattaattaaagtggttaaaccaaaaaagaaagatgaaaataaaaataaaaagtaattatttttttatctcagtaaatacttcatccaatgcattaattaaagcatctatatgctctttctctacaattaatggaggtaaaaatcttaaaactgtgtcagaagtacagttgattaaaaatcctttctcaagcattttcttaacaatatcagctccattaaattcaagctctgctccaatcattaatcctaatcccctaacctcttttatgaagttgtatttctctataaggttttcgagttttcgaatgaaatatttacctttctctataactttatcatctttaatcaattcctctataacttcaactgacgccaaagcggcagagcaagccaatggatttcctccaaacgttgttccatggtctccataactcaatgcctttgcaatctcttcctttaaaacaacagctcctattgggaccccccctccaagggcttttgccaatgttaaaatatctggctcaacaccataatgctcaaaggcaaacatccttccagttctccccattccacactgcacttcatcaaagattaagacgatatttttatcatcacataaatccctaacggcctttaaataatctttatcagctacatgaattcctccttctccctgaacaggctcaatcattatagcagcggttttgtctgttatagcctcctttaacgcctctatatcgttgaatggaacatacttaaatccaggaggtagaggataaaacccatcctgatactttggttttggtgttgctgccagtgttgttaaagttctaccatgaaatgcgttatacatgctgattatttctcctccttctcttcctaatacttttgatacatacttccttgcaaactttatagctccttcgttagcttcagctccactgttgcagaaaaatgctctatccaaaccacttagctcaactaactttttagctaattttatttgagggattgtgtaatatatgttggaggtatggattaaagtttcagcctgtttttttattgcttcaacaacctttggatgacaatgccctacattattaactccaattccagctaagaaatcaagatatttctttccatcaatatcataaacttccattcctttaccttcaactaaaacaactggtaatcttccgtagatttggagatggtattttttctctaaatctatccaattctcttggctcatttaatcaccaaaatgattttaaaattaaaaataaaacttttaagggaagtaatgcattataagtatttatattttgtgttgttttttgttgagtattttaatcatttttgatatggtttaagtcaccaacaaaacatttttatgtgaaagtatttttattaatattgctataattaatctttttggtgataagtatgcataaaatatgtgttatagaaggagatggaattggtaaagaggttgttccagcaacaattcaagttttagaagctactggtttgccatttgagtttgtctatgctgaggcaggggatgaggtttataaaagaactggtaaggcattaccagaagaaacaattgaaactgccttagactgtgatgctgttttatttggagcggctggagaaacagcggcagatgttattgttaaattgaggcatatattggatacttatgcaaacattagaccagttaaagcatacaaaggagttaagtgcctaaggccagatattgattacgttatagttagggaaaacactgaagggctttataaaggaatagaggcagagattgatgaaggaattacaatagctacaagagttataacagaaaaagcatgtgagagaatatttagatttgcttttaacttagcaagggaaagaaagaagatgggcaaagaaggaaaggttacatgtgctcacaaagcaaatgtcttaaaattaactgatgggttatttaaaaagatattttataaagttgcagaggaatatgacgatataaaagcagaagattattacatagatgcaatgaatatgtatatcataacaaaaccgcaagtatttgatgttgtagttacttccaacttatttggagatattttatcagatggagctgctggaactgttgggggattaggtttagctccttcagcgaatataggagatgaacatggattatttgagccggttcatggttcagctccagatattgctggaaaaaagatagctaatccaacagctacaatattaagtgctgttttaatgcttagatacttaggagagtatgaagctgcagataaagttgaaaaagcattggaggaagttttagctttaggtttaacaacacctgacttaggaggtaatttaaatacatttgaaatggctgaagaagtagctaaaagagtaagagaagaataaattaatctatttttctttagaaagcttttctattcttttattttaaaaatttaaaatgaaattaggtttttatttattaggaggtgattttatgagattggccatcattgattatgatagatgtcagccaaagaaatgttctatggaatgtatgaaatactgtccaggagttagaatgggagaaaagacaatagagattgatgaaaacacaggaaagccagtaatatcagaagttttatgttctggctgtggaatatgtgttaagagatgtccatttaaggcaatatcaattattggattgcctgaagagctgagtgaggataagatagttcattcctatgggcagaatagatttaagttatttggtttggttatcccaagagatggggttgtagggattattgggcagaatgggattggtaaatccactgtcttaagaattttagctggagagttaattcctaatttaggaaaacatgataaagagccaaactatgacgatgttataaaatactttagagggactgaactgcaagaatactttgaaaaattaaaaaataaaggagtaaaggctatccataaagttcagtatgttgatatactaccaaaggttgttaaaggaaaggttggagatttattaaagaaagttgatgaaaagggcaaatttgatgaggttgttgagaagttagagctaaagaatatcttagatagagagttaagccagttatctggaggagagctgcagagagtagctattgctgcagcatatttaagaaatggagatatatacttctttgacgaaccatcttcatggttagatattaggcagaggtttaatgccgcaagattaattagagaattaaataaagttgttgtagttgaacacgatttaattgttttggattacttatctgattatatccatattatgtatggggttccatcagcttatggtattgtctcaatgccaaagagtgttagagtgggaattaatgaatatctctatggggagttgagggaagagaatataagatttagaaaagagccaattatatttgagaagagggcagttattgactttaaaaataggccaattttgttgagctattcctcaatgaaaaagactttgggagattttaaattagaggttagtggaggaactatttacaaaggagaggttattggtattttagggcctaatggtattggaaaaacaacatttgttaagttattggctggagtaattaagccagatgaaggagaggttatcaaagaaggagatataaaagtttcatacaaacctcaatatattactccagattatgatggaacagttgaagatttattgagttcaataaccaatatacacacttcctactacaaatcagagataattaatcctttacagttagagaagctattggatagggaagttagagagttgtcaggtggagagttgcagagggttgctattgctgcctgcttaagtagagacgctgatatctatttattggatgagccatctgcatttttagatgttgagcagagattgagagtttcaaaagtaataagaagaattgcagatgaaaaagaggctggaatgtttgttgttgaccacgacatactattccaagactacatttcagatagatttattgtattcagtggagagccagggaagtttggagttggtagtagtccaatgaataagagagatggagctaacaaattcttaaaagaaatgcaaattacatttagaagagacccagagacaggaaggccaagagctaataaagaaggaagtcaaagagatattatgcagaaggaaaaaggagagtattattatgttgatgaataactaagaggcatcatcgagcgaagcgatgatgatgcatccaatgaataaaactaataaaagggataaaatggaaaaaaggaataatccttctgctttaaatatttttatgtcttttttaaaacttgggatggtagcatttgggggaccaacagcaattgcctatgtcagagaaatggtagtagatgagaaaaaatggatggatgaaaaaagttttaataatggagttgctttagctcaaataattcctggagcttctgtgatgcaagtagcggcttatgttgggttttatcttagagggattgtaggagcttttgctgcttttatggcttatgcattgcctgcgtttttaatcatgttatttttaacaattatatatatgcatgttaaatctttgccaaaaactgtttcaatttttgaggctttaagaattattgtggtatcattagctgctaatggaacactaaactttagtaaaaaaaatattagaactatcggggatgtttttttacttttaatatcggcattattatttattttaaaatttagtccgtttattgttatctttgtatcgatatttattggatttttaatgtataggcgtgatattacaaaactttcattaaagatagatataccaagagaaaagttaagaatatataaatatgtggcttatctgttatttggagtgtttttatttaatttaattctttatatgattgattcaaaattattcctactttcaacacttatgatgaaagttgatgtttttgcttttggtgggggatatgggtcagttccctttatgttgcatgaggttgtagataaatacaatctaatggatgctaaaacctttatggatggaattgcattagggcaaataacgccaggacccatagtaataactgccacatttgtaggatatattgttggaggttttattggaagtattatttctactataagcgtttttacaccttcgttcataatattgttatcttcaattccaatatttgacagtttaaaacataataccattttcaagaatattttacatatgatattagtatcattcgttggcttgctggtagcagtaactataagatttgcactcttagttgattggtcaatacaggcattaataatatttattgtatcatttctattgttgtataaaaaatataatatgttattagttgtattactaagcttagttttgggatatttaatattataaaacatttttaggtgagaaaatgatttttaacgagtatgaagagttttgcaaaaagatggatgaatgtattgaaaaatacaaagggaaatttggatgtattgtaactttcaatggatttgttagggagtatgatttaaaagatggagaaaaagttccatcaaaaggaatgaagatagatgaagacatcttagaaaagttgaagttagttattgaggaggcaaaaaataagtttgatgttattgatatcttattttaccacaacactggatttttaagtattggggagaggattgcttcaatagccgtttttgcaagacatagaaaagagggttttgaagctttagaatatataataaatgagatgaaaaaatatcattaaaggacttttacctcaaactgacagaaatcatgccccaaacctgcacagtgagtttctttcactctaactctcttgtttaatattttttctaagcatccagcaataaagcctccttcaaaccaacataatgtctctccaacctcaggaagtccagaacaagagatacattcataaaccctaatttacaatggctctttattaactatctccacctttccaattttatattcctcacaaaacttaactacatcttcaacagtttttggatttaatgccagtccaagctctcttccacattcgtaaataactccatgagcccctcttcctaaatatctttccaaatccataaatcttattaatctaaaaacagttacgtcaatatttcttcctaatgtatctcttttttgatttgataactcttcaatggtgaattttaatgccataatatcacctatattgtaaaattccaaaataataatttcgaatattcagtataagtattactttattatgattatttgaataatttatttgaacttcttctaatcatcccctcaacagcactctttccaattaatgatactgcctcttttattagcgcctgtggagctactaaataggtctggctgatatctttctctccaatagttgatttatcaaactcttcaataatctttaaagctaaatttaaatcctcctgtctttcatcaattaacatgttctttgcagatgaaagtaaagcgtctttgttaaatactttcattaatccctccattccagaagtttcaataattgaagcaattgtttgtaaagatatcaatatttgcttttctatcatatcctttggagcgttgataatctgcgttccaaccctataataatccaaaactccaactaaggcaactgcagtgactaaagcccccatatccgcaactgcaggaacaacatctgcaggagttacataaggaatctttccaacgctttttaccaattcaactaatttatttatctgatcttctgttgcatactcttttccttccaaagcttttcctgcaattgtgtaatatttttgagaaggagttccaggaactcctgttgggtgcattgagctaataccaacatctctcctctttaatcttaaaattccctccaacgacctatacaaaacaggagttgggatagtacaagtgttacaaataattgcattctctggaacatgttcaataattgtatttgcaatgtttaatgttattcttccgaatggtgtaaataaaacatgaatttccccatgctttgcagcttcgatatcatcactaacaaccttaactccagcatcctcaaccttcttccataaatcatcactcataacatccctatttggttcagataaaacaacatcatgtcctgccttagcaaattcaatagccattccagctcctccataaggtggctccccaccaaacttttctggaactttcaactgttctaaataaagcctctgattcccagctccatatattgatattttcattccaaatccctcattgtaaattttgaaggattagaatttatttaaaacattgcttttatcttatctgccgctcttttcattgttattctaattaaacccaaattaacttttgcgtcagttaagactactaaaattccctctcctgcatcgaccattaatgttttcccatgctctccttcaatcattgtttgttctaaaccacttaacccaatctcggaagaggttctctcagcagccccaaatgctgctgaagccatagccccaactaattcagcatctacatttcctggcaattgagaggctataactaacccatccttcccaacaaccattgaacctttaactccatcggttctatttagctctaataaaactctgtcaatcatactctccaccaaaattttttacgtttaattatgtttgaatttgttttatataaactttatcataaaatttaatatgtatattaaaaattttaataatatcaattagattttcaaaactacatattaaaaaattaaataataatcaaatttaaaattaaatggagatattattttttggtgttaaaatgaaggtaagaattaaagttaaaggtatagttcaaggtgtagggtttagaccttttgtttatagaatagctaaaaaaaataatttaaagggctatgtaaaaaacatggggaattatgtggaaattcttattgaaggaaaaaaagaggatataagaaattttatcaatgatttaaaaaataagaaaccgccattgtcaagaattgataaattggatattgaggaaattaaaggaattgaagaatttgatgacttctatattataaagagtgaaaacgctaaagatgaggaagaaggcactataccagctgatgtagcaatatgtgacgactgcttaaaagaaatgcttgataaaaatgataggagatacagatacccatttattgcatgcacaaattgtgggccgagatttacaatagttgaaaaacttccctatgatagagaaaatacatcaatgagagattttcctttatgtgaaaagtgcttggaggaatataaaaatcctttagataggagatttcatgctcaagccacttgttgcccaatttgcggtcctaaggtatttttgagtgatggaaaagagattatagctgaaaaagatgaagcaattagagaaacagttaaattattggaagagggtcatatattagctataaaaggaattggagggactcacttagcttgtaaagtaggagaggatgatgtagttttagaattaaggaagagattgggaagaccaactcaaccatttgcagtaatgagtaaaatagaatatacagagctgtttgctgaatttgacgaagatgaaaaaaatgctttgttatctttaagaagaccaatagttgttttaaaaaagagccaagattatgataaatatttttcaaagtatgtttctaatttagacactattggagttatgtttccatacagtgggttgcattatctcttatttgataaagagattgcttatgttatgacctctgctaatctgccaggattaccaatggttaaggataatgatgagatattaaaaaaacttaacggtattgctgactacttcttattgcataatagaaggatagtgaatagatgtgatgacagtgttgttaaaaaggtagctgatagattagtttttttaaggaggtcaaggggatttgctccagagcctgtaaaggttaatataaacaataataaaaatatcctatgtgttggggctgagctaaactcaaccgcttgtattgtaaagagagataagttttatctaacccagtatataggaaatacctcaaagtatgagacattctgctatctaagagatgcgataaacaacattttaagattaacaaacacaaataaaattgatgctattgtttgtgacttgcatcctcagtttaattcaacaaaattagctgaggaattatcagaaaaatttggggctgagatttttagagttcagcatcattttgcacatgcttatagcttattaggggacaacaactatttcgatgatgcaataattttgtcgttggatggggtaggttatggattggatgggaatatttggggaggggaggttttgttatttaaagatggcaagatggagagagtagggcatttggaggaacagtatcagttaggaggggacttagcaactaagtatcctttgaggatgctactttctatattatataaagccattggtgaggaggcatttgattttataaaaagatataatttcttctcagaaaaagaacttagattattaaaattccaacttgagaaaaaacttaactgtccaataactacatccactggtagagttttagatgctgtttcagctttattaggaatttgctttgaaaaaacttacgatggagagccgagtataagattagagccagtggcaaataggtttaaaggagatattaatatagagccaaaaataaaaaataacatcttaaatactacagaacttatttacaaatcttatgagatgctattaaataacgaaaataaagaaaaaatagcacattttgcccatatttatatagcagatggattatttgagattgctaagaaaatatcgaataaatttggaataaatactataggcattactggaggagtctcatataacaaaataataactgaaagaattatgaataatgcaaaaagggagggttttaattttatttatcatcaaagagttcctaatggagatgggggaattagttttgggcaaggtgttgcctatatcttaaaaaatggatattaattggggctgaaagccccaacttaatggataacgggtatcccaataggcagagccctatggggcgggattagttttggacaaggaatagcttatattttaaaagaggggtaggatgattatagtcacaccaagatatacaattatagaagatggagcaattaataaaatagaggaaattttgaaaaaactcaacttaaaaaatccattagtgattaccggaaaaaatacaaaaaaatactgtagatttttctatgatattgtatattatgatgaaattttaaacaatcttgaaattgaacttaaaaaatatactgcctatgattgtgtaattggtattggaggaggaagatcaatagatactggtaaatatttagcttataaattaggtattccatttattagtgtgcccacaactgcgtcaaatgatggcattgcctcaccaattgtttctataagacaaccctcatttatggttgatgccccaatagccataattgctgatacagagataataaaaaaatctccaaggagattgttaagtgcaggaatgggggatattgtttcaaatataacagctgttttagattggaaattggcttataaagagaaaggggaaaaatacagtgagagctctgctatattttcaaaaacaatagctaaagaattaataagttatgttttaaattcagatttgtcagagtatcataataaacttgtaaaagcattagttgggagtggtatagcgatagctatagcaaattcttcaagacccgcctccggaagtgagcatctcttctctcatgctttggataagttaaaagaggagtataacttaaatataaattccttacatggagaacagtgtggaataggaacaataatgatgagctatctacatgagaaagagaataaaaagttatctggattacatgaaaagattaaaatgagtttaaaaaaggttgatgctccaacaactgccaaagaacttggatttgatgaagatatcattattgaggcattaactatggctcataaaataagaaatagatggactatattaagagatgggttaagtagagaagaggcaaggaaactggctgaagaaacaggagttatttaaacaatctttgctaaagctaaaattatctccaatagtattaaagcaacaattgttccttccaacaataatccataaaactcagttaaatgttgccttgtcattgtgtatatatcactaatcatttccatttttttctctactcttttaatccattctgagacgtagaatattttacataatctttcatacaactcagcataatatctgtctccatacaacataaggacattttcaatgctatcaaaatatgatatatagctgattctttgtagatataaatccttagatagtttttttagcttaaaatatccaagtttttcccactgtaatcttgtgaaatattgtattgcttcacttagcatactgtcaaatactcttaaattcaaaactctaatacaggcaagttcgataatatcaacttcttcccagaaatcttcatttttatctaagattattccattatcccaatccaaaattattaaatcttttgttgaatactttattttgctttttaataattcatttatatattcctctggaacttcttcatactgatttctaagaagttttgttaatatactcttattttccttgataaatgagtcagggtctgaatactcactaaagcagtataaagtgtagctctctaagaatttatctgcattatatttttttaaatagcttaaagcttcatcaaatagctcttctttaagttcaaatagttctattaaatccttatttttaaaatctttaacaatctctacgataatgttcttttcatatacttttattgctatctctttactttcttcagtaatcctttctattaaagagtatgttggtaaaaactcctcatagctacaaattctcttcatcctaagttttatcatttgttcagaatagatattttcttttaaataccccacaagtatttgaacaatcttaccacttagaacactatccattttctcccaatttttaatctcttttttaaatttaattttactttttgatatataaaaacctttaatttagataaaataatttatatttattaatttaagttcattgattaataattaaaaaaatatagaacttttgcaggaataaaattttagagaaaattgatgccctttgagcatctaaattccacgaagttaatataaaactgcgaaaattctataaaaaatagtgcgggtatgggggctatagcccgccttctgtaatttcggtgacattcggctaagcgccgaaaccggcttgcaccccgggcaggggagatgcccgtttcaccggttctccggaagtcctcaactttcactatcatcgtcatctcttccggagccgtgtcgtttctgctgcatctcccgccccttctcaggggacgctgcccataaatggggtgggcggaacttcctcccctcttaaagaggggaaagtcaccagcccccttacccgcttaactttaagatttgaatatataaatgttattttctaaaataataaaaagtggccggcggtgtcgcccctttcccgccagatggcagtactcggggcatcgctggggggcttaacttccgagttcgggatgggttcgggtgtggcccccccgctatgaccgccgtaccaagaaataaatggtgcctttttttgggccatgcataggcttccacatccgcttagtgtctggataccctgccgggcccttgggcgattagtaccggcgggctgaacgcctcgggcaaagccctcggcgcttacacccccggcctatcaacctcctcttataggagagccctcgtccccgaagggactggccgcctattttcggggagggtttcgggcttagatgccttcagcccttatcccttagcgcgtagctgcccggcaatgccctgtcggacaaccggtagaccagaggcgccggcggctcgttcctctcgtactagagccaccttcccctcaggcggccaacacccccagcagatagcaaccaacctgtctcacgacggtttaaacccagctcacgatcccctttaatgggcgaacagccccacccttgggccctgctgcaggcccaggatgggaagaaccgacatcgatgtagcaagccgcggggtcgatatgggctcttgcccgcgacaactctgttatccccggggtagcttttctgttatccctggcccccatcggtgaggcacaggggttcgctaggcccggctttcgcctcttggtcggcctcttttaccgaccaagtcaggccggcttttgcccttgcactccacggcggagttctgacccgcctgagccgacctttgggcccccctgatgccttttcaggggggtgccgccccagccaaactgcccacctgccggtgtccccctttacggggttagggacatggccatgggtgggtggtgtcccatgggcgcctccaccacccccggaggggtggcttcgacggctcccacctacgctgtgcacccacggccatgccccaacgacaggctgcagtaaagctccacggggtcttcgcttcccactgggggtctccggcctttgcaccggaatggtaggttcaccgggttccggcccgggacagtgggggtctcgttacgccattcatgcaggtcggaacttacccgacaaggaatttcgctaccttaagagggttatagttacccccgccgtttaccggcgcttcgcccggttgtacccgggtttcacgtaccggcactgggcaggcgtcggccttggtacacacccttacgggctagccaagacctgtgtttttattaaacagtcggacccccctggccactgcgacctgcggtcccctcacttagagaagaccgcaggcaccccttctcccgaagttacggggccaatttgccgacttccctgggccggattctcccgacacgccttaggatactcgcctaggggcacctgtgtcggttctgggtacggtcaccggggatccttgccagctcccttttcacgggctccagggctcagccgaaccctcctaacggagggcccatcacgcttttgcccggttctcgccattacggcactccccgggcttatgcgcttggccaccccgacgggggtggtcggcctaccccgaagcgtcaggagctggccttgcgttgccgcacgtaccccggtggcgcgggaatattaacccgcttccctttcccccccagggaattaccccgggggttaggaccggctaacccacagctgacgaccgttgctgtggaaacctggccccttcggcggtggggattctcaccccactttgctgttactactgccgggattctcgttcccacggggtccacccgacctcacggccgagcttctacccccgcgggacgcccccctaccggatggcttttcagcccccccgggtctcggcggccggcttagcccccgttatcttcggggcccctgacctcgacgggtgagctgttacgcactctttaaaggatggctgcttctaagccaacctccccgctgtcttaggccagggactcccttctcatttacacttagccggcacttaggggccttaacccgggtccgggttgttcccctctcggacatacggcttacccgtatgccctcactcgggggctacggcgatgacgggttcggagtttgacagggtgccgagggctctcgccccctaaacaccctatccgtggctctaccccgccatctacctaacccccggctaacctgcgagttatttcggggggaaccagctatctccgggctcgattggcttttcacccctagaccggggtcagaggagcactttgcgcggtaacacccctgcgggcctccacccctctggcgaggggcttcaccctaccccggcctagatcgcccggtttcgggtcgtacgggtgtgactccgggcccattaagaccccgcccctcacccataagggttgcgggcatgtcggtttccctacgcctccggggttgaaccccttaggctcgccacacccgtacactccccggcccgtttttcgaaacggacggcacgaccccggcatgccacccctcgtactcctccctcgcgggagtttccttcggggtggttacctttcgggccgtgccattccgtacccacctggtttcaggctcttttcaccccccgcaaggggtgcttttcagctttccctcacggtactagttcgctatcggtctcgggacgtatttagggttggaagcctaatgtctcccagcttcccgcgcgatatccaacgcgcggtactcagggacaccccagacccccaactggttacgcctacggggctttcaccctctatggcgccccattccaggggacttcggcttcccagtgggggtctatattgggggccctgcaactccacatctccctacccttacggatagggattcggtttgccctgtgccggtttcggtcgcccctactcccggcatccctgttggtttcttttcctgcgggtactcggatgcttcttttccccgcgttcccgctccctaacgggagcgccccaaatggggcaggaagtcccattcggggatcccgggttccacggctgcctgcgcctcccccgggcttatcgcagcttgccacgcccttcctcggcgccccgagccgagccatccaccaggtgggctggtggcccggcagagtatccagatttcaccgggatgtggaagcctatgcatggccctcatgtttttacgggactttcgcagtttgtaatatttataaggtagtgagatgctgaaagcatcaattaccaaataaaaattatttcctgcgaaagtcccgtatcaggcccttcacctgcaactctttggagttgcaggctgcatatatagtggacccggtgggatttgaacccacggcctccggcttgcaaggccggcgctctcccagctgagctacgggcccactttccctatgaggcaagcccacgactggtttggtgccccgcagcaaccagcgcttttttctcaggaggtgatccagccgcaggttcccctacggctaccttgttacgacttcgcccccctcgctgaacccaagttcgaccctgcccttgcggacagggcctcacttgggctcaactcgggtggcgtgacgggcggtgtgtgcaaggagcagggacgcattcaccgcgccatggtgaggcgcgattactacggattccggcttcacgagggcgagttacagccctcgatccggactacgaccgggtttaggggattcgctccccctttcggggtcgcgtcccattgtcccggccattgtagcccgcgtgtagcccaggggattcggggcatgcggacctgtcgttgcccgcaccttcctccggcttagcgccggcggtcccccatgagtgccctcctcccggaggaggaggtagcaacatggggcacgggtctcgctcgttacctgacttaacaggacgcctcacggtacgagctgacgacggccatgcaccacctctcggcgcgtctggcaaggtcgtcaacctggccttcatcctgccgtcgcccctggtaagatgcccggcgttgaatccaattaaaccgcaggctccacccgttgtagtgctcccccgccaattcctttaagtttcagtcttgcgaccgtactccccaggcggcggacttaacggcttcccttcggcaccgcgtcggcccgaagccgacgcgacacctagtccgcagagtttacagccaggactacccgggtatctaatccggtttgctcccctggccttcgtccctcaccgtcggacccgttccagccgggcgccttcgccacaggtggtcccccagggatcaacgcatttcaccgctacccctggggtacccccggcctctcccggtcccaagcccggcagtatctctgccagccctgcggttgagccgcaggatttaagcagagacttaccgggccggctacggacgctttaggcccaataacagtggccaccacttgggccgccggtattaccgcggctgctggcaccggacttgcccagcccttattcccggagctgtttacactccggaaaagcccacgcagggcgtgggcactcggggtccccccgtcgcgctttcgcgcattgcggaggtttcgcgcctgctgcgccccgtagggcctggacccgtgtctcagtgtccatctccgggctccccctctcagggcccgtacggatcgtaggcttggtgggccgttaccccaccaactacctaatccgccgcagccccatcctcgggcggcttacgcctttcggggagggatcattccagacctcctcccctatgggggattagcctcagtttcccgaggttatcccccacccgagggtaggttagccacgtgttactgagccgtgcgccggtgctccccgaagggagccccttgactcgcatggcttagtcggaccccgatagcagtggcctccggcaggatcaaccggaattaagtgggaggtacggtcgcaagaaaggataaacctttcttgcggctggttgctgcggggtttcaccaccagtcgtgggcttgcctcagccccaacccttcggattggggacgcatccttaaatagggcttacgcattattttattgaatttggaattttgaagccctaaagggcatcatttattccaataggaaacttacccgcgtaagccctatttcaagtgcatccaataacaggaggttgttacatgcaacgtttttaggaatagaacaattaaggttgaaaaaaaataaaaaagggccgggaccgggaattgaacccgggtcaggggatccacagtcccccaggatggccactaccccaccccggccactttacctatggtgcaggggcagggatttgaaccctggaacccctacgggactgggtcctaggcccagcgcctttggccaggcttggcgacccctgcacatatatattcttaattatcttaaaataggacgaatgatgctccggccgggatttgaacccgggtcgcgggctcgaaaggcccgcatgattggccggactacaccaccggagctaattagtgattttaatatggtgggcccgaagggatttgaacccttgaccactcggttatgagccgagcgctctgaccaggctgagctacgggcccatattgggtataaaaaaataaaaaattaatggcgcccccagcaggactcgaacctgcgacctacggattaacagtccgtcgctctaccatctgagctatgggggcacatcaatggtgccgcgggggtgatttgaacacccgacaactggatcttcagtccagcgttctcccaggctgaactaccgcggcacccaaatgtttgcataattatgcattacatttcaggtatataaacttttcggttaggtatttaaatatttgacttacaatttaattaatttttcataaattttcataaatatttttagtaaatgtaataatattagattttcttataaacatggatgtgtctaatcagccctttatggatatataccttgtagagtccctctaattccatatcaagctctatcttttttgggtatgcaaaaacaaagtagccgttatctttaatgacctctggaagagtttctaatatcttttcaatctctcccttttttgctgtagatattccataaggcgggtctgttacaatggcatcgactttttctatatttagttcatttaaaaactcttttacgtatttggcatctaatcttttaacttttatcactttatctaataggttgtattcttcaaggttgattaaagttccagaagccattctccaatctatatcacaaccaataagcttagctccgattaaaccagcctcaattaaaaaccctccagtcccacagaatgggtctaagacaatatctccttctttaactcttgctagatttaccatagctcttgcaagttttggaagcatacaacccggatggaagtattttcttaaatgtggcctattcttttggaagtattccctatctctcatctctaatacattggaaataaaaaatgtgttttctaaaataacaactctaactaatatatctggttttgttaaatttacttttgcattggtttttaattttataatccctccaatttccttctcaattcttaatgagtctatagattttgtaaattcatctttatgaagttttaaaactctaacggcataagatttactctcatcaatatctggataatcaatatttgctacaaaatctttaaatgagtttataaaatcattgacaattttatctactaaatctacacttttttcttctaaattgtatctaaatattatcctatgcccctcatctatatacccacttcttttaacgatatctttggcaggactatcttcagttataacgtatctttttaatctctcaacacttccattgtaattaaaaatttctaataatgccataagttctccataagggatttcttcatgctctccatttaaaacatatccaatcataattacccctcaaaatatttttaattttatttagattttattaatgcttttatagctaaaactccaaatagaaatgcaaaaattccagctgtaaattctccaaccactaagccgctatatattccaaacattcctaatcccaatattactgcaaatagataagcataggatatatgacatattagcgacctaaatatggaaattattaatgatttttctcctttaccaattccttggaacattgcggatgttgttaaaataaatggtgtaaatagtaaatataatggaactattcttaaagctttaacaagttcttcatgaattcccattgaggtttttgtgtaagtaaatagataagctaagattggggataagagcattattaaagcaactataataatttccattaaaaccccaatttttattgtgtaaaaataagctgtttttaatttttcaaaactccttgctccgtaagtggctcctataactgaagtagctccacttgccaaacctaacattggaataaagccaaactctgttattcttaaagctccagtatagacagctaaacctctactatctccaaccatcataattattgaagtcattataaaaaatgatactgcaacagtaatctctatcaatgctgaaggaattccaactctaattaaatcggctataatctttaaatcaggtttaaattttgataatttaactgtaacataacatgatttttttataaacagctcataagctaaaattaagagagatataattatagctatcaaagtagcataacttgccccacttatccctaaatttagcatatagatgaatatcgggtctaagatgatgtttgttaaagtgcctataacgcttgctatcataactatctttgtatttccctcccccctaaatatcccatataacgcatcgcagattgtaaatataacagttcctaaaaccagtatgctggagtattttatagctaatgacttacaatctccataggttcccattaagctaaatagcgtatcaagatttggatatacagctataatatacaaaattccagcaattaaagctaaaataattgcatgatttgctactttatcagcttcttctttattttttgctccaactcttcttgctattccagagctaatcccaatactcaaaccccaactaactgcatatatgctaattaatattggaaaactcgctcccacagcagctaatgcatctgcccccaatccagaaacccagatactatcaactaagctatagattgattcaatgaatgtagcaacaattattggctttgatacttcaattactgctttttttgggtcatccaacaatatttcaacatttttcatcgtctatcaccacaataacagtaaaaaataaatactacttatacaacttaattttctttaccatttcacaaaattgtgataacaatgccgaagcttttcatatatcatgcaaatcagtgcaatccaaaaaaatgcacatccttaaaaatggctaagatgaataaagccattttgttaaaaaatccttataaagttccaaaaaactctttaatactgaatccttacgctgaaaaagctctatctccagaagataaagagatagtggaaaagtttggaataactgctttagattgttcatggaaagaagcggagttaatgtttaagaaatttaaatttaaaaatcaaaggtctctaccgtttttagttgcatgcaaccctataaattatggaaagccatgcatgctttcaacattggaagcttttattgccgctttatatataactaactttaaggatgaagcttgggatttaacctcctgttttaaatgggcagaaacatttataaaggttaattatgaattattagaaagatactcaaatgctaaaaattcaatggaagttgtggaaattcagcaggactttctcaggaaataaatattctattgattattgctgcctaaagggcatctaaagttccaaaagtaaaatatataactaaaatttaaatctgtcaaaaaacataaaaacatataaaaagttttaaaaagttttaatatgtttattaaaaatctgtaggtgagagaatgccatttgaagaagcaatgaaaaggttatttatgaaaaagatttgtatgagatgtaatgcaagaaacccttggagagctacaaagtgtagaaagtgtggatacaaaggtttaagaccaaaagcaaaagaaccaagaggataagcgagctactttttgtttattcttttttatatcttaaaactcaattaagaaaacatgattttggctattttaaaggttatagtcccttcaacaattccagcaactatgaatagtattatagagagtatgagcaactttaaagactcttttatgtaatataaaacctctcttttagttccaaatttgatatttattaagaaattaactaatcccatgttaaataaaaccccacctgatgctgaaagtattaaagctggaatttcaatgattccatgtggtaaaactaaatagataaagctttcagcaccaaatttgtaaagcacgtatgataagatataggaattaactgcaataacaaatagtgaaaaaatcccaaggatatagtttaaaatacatacggttaggttatttttccaaattgctaatattatatgtaagttatcctcatttaacgtaatttttagattttcaacatgtttttgaaaattttggaagatgatatctcctaaatatgagaaatactttatattaactaccaaaatatataataatactaaagataagataaaaaccaaactaacaaataaaataactttcttatttcttatagggctttttagaatttcttttaaatcaaatatctctttcaatgcgtccattagcaccatcattaaataagcatctctcataattatctaccgagttcttgatgagcttttcctaaatgtccagctgctaaagctcctaataaagataactccccagctaaaactgcagctccaacaatttcagcaaattttaaagctttattatctccgtagcaaccaagcatctctaagcactctttttgtgtttcaacccttgttcctcctccaacagtcccaataggaacatctgggagagttactgaaaaatataatccatcatcttcaacttcagccattgtaattcctaaactaccctcaactatatgtgcctcatcttgcccagtagctaagaatattgccccaatgatatttgcataatgggcattgaatcccattgaattgcttattgctgaacctatataattctttaacctatttacttcagctatagcttgggaagtggtttttaggtatttattaacttccttctcagttaaaaatacctctgctacaatagatttccctctaccattaattaagttcattccactaggctttttatctacacatgcatttccactgacagcaactgttttaacaaatatgccttctttttttaattccccctctataaaattacatgccttctctgttgcaattgtaaccatattcatgcccatggcatctccagttttaaatacaaatcttggatatagatttcttccaacgattaaaattggctctatctttattagctttccatgccttgttgttgattcagcaacttcctttatcctctcaaagttttctctaatccaatctctgacttttattgcatctacaacactctttgtttttaagcaaggggctcttgtcatcttatcatctataaccctaacagttgcccccccacattttgttattattgagcaacccctattaaccgatgccaccaaagctccttcagttgttgccaatgggatgtaaaactctccctttgcatattccccatttatctttaaaggcccagcaaaacccaatggaatctgtatagctccaatcatattttctatattcttcttcatagccatttcttcatctattgagtaattgcatatatgcttaaattcaatcccaacctttttttcaataaattttcttctaatttcagttgctatttttgaaccaaacattttatctaattgatatggctttatttctccatttaacattttttcaaggatgtcattataattttccattttatcaccagattagtttagttgttattttgtgattcaagttctcttagtttattattgcatttattaattagtttttcgagttcatcttttagttcgttgaatatctcttcatctaacttattctcattcttttctttttcatatttctctaataattcttttaaatgatgcacaaatatttcaaggtatgttttatcgttgaacatctcataattgctaatgttgttgtatgtttcacttaaaaatttattaatactattaatgtctcttgttttaattttttcttcgatagttttgtaaaatgaaactataaattctgttttcttaaaagcttccaaaccttttttagagtatggcttatttttcctatttaaacaattttttctatattcaactcttaatttactaagaattcttaaaaaatccctaagatatttttcacgtttttcatctttaataaacatccagtatttattaaagtttttgttaatcatatttaagcattttattactgcataaacatctcccactttaattctcttctcaataatttcatagactgcgaataatctcgattcagcatcagttaaatcaccatagcctcctgatttatctcctatatctttatctctcaaaattaaatcgactgcatattttggatttataacatttgcaaatgcttttatatataaagcatacattaagaaatttaacattataacgtaataaataattccatagtcaattacatgcaattgaacatgtgttaatgaaataagaataaataaaaacacagttgtgaaagaaattactacaaaagttaaaaatcttacatctctaacccatatccacattaagatattacttaatctatctgatgatgtctgaataataacccaagatattgatacaagtagtgctgagatagttgctaaaatactccctactgtaaggaaattactgctgtcactgctattggttattaaagaccataatgaatcataattttttattgcaacaaccactgctatagacacaatcatagagagaatgagaagatagttttgaaaagttgtttgcaattttttaagccctttccaatcaaatatttcaacaatttcccatttaaaaccttcaaatgcaaacatgtaaagaaaagcataagcaattaagagaatagatatccatttattaaaatctcctacaaataatgtgaatattgtagttataataatttttttaattatattaatagcttaaactctatataacagtgtgaatatacgataattgatataataattatggacccaattattgataatataagaccttgatatgaacgttcttttttacttaatatttttctaatggttttagaaaaagtaattaatattaaaaacagaattaaaaataacataccccataaaattgaaattgtaaatgcaacggcactgataacaataccaacgattgtaattattggtttaataaagttaatccaatttttaatgcttttaattttatctctaatattcatattacccaccaaaaaaataataaaatagttctatacctcaacttcatccaactataacaccatcttttaaatatgtttctgtaaaaagtagtgtttattttttcattagattgaattcatcaactgatagaactttattaatcaccaaacttattaataatctcctctaaatctaaaacccctttatgtattgccgttgctattaaaacagcatcaactcctaagttatagcatagctctaaatcttccattcctttaattccaccaccaacatacaccggattgttagttttatctaaaacatattttataagctctgcattaacccctctttgagttccaactgaagagatatctaagattattagtggtgtatcatctctaacacaagataaaatctcatccaagctgtagtttaaaagattcccattcttaaaatctaagctaacaactatatctttttctttaagcaattcaatatcttttaatgtctctgttgctacaattgccctatcatctttatttaaaacttttttgatagtttctaaatcctctctactctttactccaatatcaacaatcttgtttataaaatctatctcttttataatatcaaaattatctccattgcccattataaagtttaagtcagcaatatagatagttttagctcctctttctttgtaggcttttgctacttcaataggatttgatgatttgcagataactgactctaatggcttatattcatctctatttccactctttccatgcacagctattttgtcttttaaatcaatgactgggattattttcatagtttccctctaaattattatttattaatatctaacctctaaaactcccctatcccattctaaataatgccccttctccccaaccttagccatgtttattattggaactattgcaggtgttgggctaatacccatcctcttctggaaatctgtttgctcttggaatgtcccgctattaaccataacaactcctctataaattccataaccgttgatgtgtatatgcccagtgtgtaaaatatcaatatccctatctataaccaagtaatctttatgttctggagctataggacatcttcctccataagttggacataatagccttctttttatcaactccttcataatagttactggattttcataacttgcagcccttatttgtccaactaagtcgtcaaagcttctgccgtgatataatagagtatcaaagccatggatgttgagagtgcatgggtttccaacgaagtagatgttatctctattaaatagcttagttattttctctggcagttttggttgaggttctgctggtctaacagcatcgtggtttcctggggagatgattatgcttatatgctctggaatctgatctaaatacattgctatttctctatactgctcaataatatctacctcatacaaatcctcttcctgccctggatagacaccaaccccatcaactaaatccccagctatgcagatgtattttaatctgctaacgaccttttcctctaattcattatcaacatctccatttaaaaatctgatgaatttttcaaactctttatgcaaaaactccttacttccaacgtgaatatcagataaaaatgccatatatatctcttcatcaattctctttggttcttttggtggtaatgctggacgtataatttcatcaacgtatattgaacttccagatttgctaacagtcccaatagctccaataacttcatctaacaaaatatcgtcaggtatttttccagcttcgattttttcttttggcagaattaacgttgcttcatcttcggtgtcttcaatcctaactatcaagttcccatttcttgtactatcaacatcactaacgattcctacgacaaaaatatccttctgtcctttcattttctttatatcttttagaggatatccctttctttgagcttttctctcaataaaaacctttaatctttcaaatctgtctctaaagtatttaacgaagtcctcaatagttccagtgcatgtggattttccagacacgtctgaatcttcatatatctcaatcacggcatcgatgtctttagctatccattttattctactatttacactctcttttatttttgttatgtgttcatatcttttagccctctcagcatcgaaatcttcttttttctcttctttggaaattagttgttttaatttctcttcaacatcttcatcagatttttttataaattgttctttttcttctttcttaacaaattctattttttctttttctattttctcttcagtttcttttttaatctctttttttacttctttaggtttttctttttcttcttctccagtgtagtaaaatataaagtcaaaatccttatattcatttattatttcatccaaatctttttgtaaaaagatgtctaaaaacttctcatctaacaaaataaaagcgttgttatattttttaaattctctaattttttgaattagtctttttaatttttcttcatcaaaattttttaacttttcataaacagttggtgataataaagcctctaaatctaagaatttatttattatctccatttttatcctccttctttatcttcttaaatctctctttcttcaaatgtttatttatattgtagcagagataatccaatggatgaatgataaatttcttcttgcacaattcgtctggcttacaataataacttaatccctttccaccatcatcttgccagtttttgcagtattcacagtgagttaatcttccatgccctaccttatagccaatattgtgcataatatagtatcttgtctttttctcatcaaagtcctcaacatttttaaacaacatctcaataagttcatctataaacctctcaatctcttcctcagaggcgatgtctgtagctgaaacattaaccaaattcccatttttatctaaaggtcttaagttagggttgaatttagcgcaaaaccaatatacaacaaagctcctccttgcgtaatgtgagggtgagccaccacttaaaatgtcatttaaaattcctctgatgcatggagggtgccattctaacgggatatttcctttatagtttaatgctttaataccacttatttgttcatatttaaccttgtcttttagataatcactaatttcatttaataattcttttactacactatcatctggtaattttcttttttttatattttccccaagtttcattagctctactctaataatttcttttgcaaaaatttctttaattttagttatatctacaaaaccattttctaaatctaatctctccaagtgtaaatcgttgattcttgaccttgaagcaatttttataaattcccagacagagattttatttggaagttttttaataactttaattttttttatttctgcatattttcttacaaaggcattaaaatatggagtatgggataataatataattaaaaggaaatctaaaagatttgtaattatttctttttttatttcaatctccttttcccttctaactccaatcataaatctactttcatctttgggtaatctcttctcaacttctccatcaatatcataatcaatcatttgaaaaatcttatcaaatatggttatttctgaactaatatttgtaaaaatcgttgaactatctccaaaaatctgcttcaatctccaaataataaatttttttgacatttttaatacatctgagaaattgatgtctatatttttaaatctttctaaatactctttaaactcctccaagtattctgaaagcataataatcacgtgtttttaaatttgttttctgtttcaataaccgctttaatgtgtggataagccaattttacatcattttctttatttactttttctaaaattctcttgttaatttcacttctaatttttgctttctcataaacattcacaagataaagtgcttttatataaaaagaactccttgtaattccaactcttacaactggtttatcagataacttccttgaaatgagatattttctcttagaccatttttcataaagttctctcattaaatttccaataacttcatctgctgattcaaaaacaattttttctgccttgtttatattgctatttagtgtaaaatgcacaactatgttatcccaaatatatggagacccttttgtaaggttttctattgaggcggtgaatatataagaatttggaataattaagacccttcctgttggttcaaaggtgtctgttgttaattcacttaagtaaatgtgttgagtatctatatcaaatacatccccagctcccatatttttaataaaaattctatctcctatctttattgttcttgtatataggatgataatccatccagcaaagtttaaaattggcttttgtaaagcgtatgttacagcagcaccaattaaaccaactgaaactactaatgatgagacattttggtagataacgccaaaaatcattaaagtaacacaaacataaacaagatatttgaagatatagtttaaggttaaatattccccagctttctcctctctcgttcttgcatactttttaaatacctccgatgcaatatctacgataataagtccagataagatgatgatagctataatcattatttgattttgatatttggcaagtatcttaatatacgtctctaaattaaaaattgacataagagagtgtaagagaaatattaacaatacaacttttattactaattttagtttattatcaatcataaattaaaccccaatggtggtctttttgctattaaaaagccaatttctatatggggaggactttaagctaagaaaaggaactttaattattgaagaaggcataataaaaggtttcacggatgaacataatgagagagaagttattgaatttaaagggcttgttattccttcccttataaatgcccacacccacatagctgataatagtataaaggacatagggattaataaaactttggatgagttggtgaaacccccaaatggtttaaagcatagatatttgactgagtgtagcgatgatttattagctgaaggcatgaaacttggtttaggagatatgagagagcatggaataaaatatttttgtgattttagagaaaatggagtaagagggattagtctattaaataaagctttaaaatgctatgattatccaaaggcaataatcttaggaaggcctataaaggttgataaagatgagattgaagaagttttaaaagtctctaatggtttagggctaagtggggctaatgagtttaaagatgatgagctaaaattgatttttaaaatctttaagaagtttaaagaaaaagatgataagaaattatttgccatacacgcagctgagcataggggggctgtggaatacagcttaaacaaatatggtatgacagaggttgagagattaatagatttaaaaataaaaccagattttattgttcatgggacacatttaacagataatgacttagagctattaaaagaaaataatattccagttgttgcttgtgtaagagctaatctatcctttaatgtaggaatgccaaagttgaatgagcttaacgacaacttattggttgggattggaacagataactttatggcaaactctccttcaatatttaaagaaatggacttcatttataagctctaccacatagaaccaaaggatatcttgagaatggcaacaataaacaacgcaaagatattaaagcttgagaatgttggtttagtagatgagggctttaaagctgtctttacctttataaaaccaacaaatgccattttgttttcaaagaatattattgcttctgtagttacaagatgtgaaaagggagatgttgtagattttagcttaatggaaaatgaagaataagacatttatagaatatttgtttataatttattattagggttttaggatttttaattttgttatttggtttatggattgtcttgttgtataagtttggaatttagaaatgagagtatttaggaattatttatttatttagaggttttaaatttaatttctaagggtttgctggtttgattgtttagaatatttaacttaattaaattatttggatttttaaaaattaagattaattaggcaagtaaataaaatttctctaacaaataagttaaatttttgaatttagaaagataaaaatactctgttttattaaagggagaaaagatttaaatactaaaaggtttatattataagatggttatttaaccttagaaaaataaggtatggaaaagcttaaatattaggagagtcgtataaattatattgtggataagtctcctattaaaatcagacctcttggaggatggaaagttagtgtctgctctccataggtcgaatatgtctccgagattaaaatcagacctcttggaggatggaaacgaagtttttgtatatctaatctattttcatcagtaaaattagactgttatggatagaatattcaaatagataaggttaaaatttgttgaataattaaaattacattcttttagagatttaaaaatatttttttagagatgataaaaaagaatttttatagcttaacctctcccttagtgcttataactcccttcctttcatcaatttttgtagctaaatctaaagctactccaaaagccttaaacaaagcctctgccttgtgatgctcattctttccaataacttcataatggatatttagcattccataacttgcaactgactcaaaaaagtgatttatattctcagttgctaagtctccaacaaactctctttttggctcataatttcctacacaataactccttccacttaaatctatcgctacagtagcccttgcatcgtccattggaattatagcccagccgaatctaaaaatattcctcttttcaatctgatttaaggctaaacctaagcaaattccaacatcttcaacagtgtggtggtcatctatctccaaatcccctcttgccttaacaatcaaatcaaaacatccatgtttagcaaaagatgccaacaaatggtcaaaaaatggaatacccgtgtctattttatattttccagttccatcaatgtttatttttaggtaaatattagtctcttttgtttccctcattacttcaaaaatcctcatattcccaccaaacatttttactaaaaaataattttaaatttatctaaaaaagctttatccttcccaaactccaacaaacataatatgtggtctttctccaaccataggaggagacctcctattgggatacctcccgtccattaagttggggcttttagccccaattaatgtccaattttatgttattttccctcccaaatacctacaaacatgacgtggtctttttcaaacggctcaatatctacctcatcaactattttaaaacctcctgcctctaaaatttctttttgttctttaaaaatctcttttgggtcttttgtaacatctatactccttgcctttattgctatcattccataaccgcctttctttaaaaaccacttagcatttttaattaaaatctccgcttgatttggctgagcaacatcctcatagataacatctaccttttcaacaatatttgcatattcttgaggtttatttgcatctcctaaaattgggattatgttttccctctcagcacatgcatctaaaagctctctcataatccttggtgcatactctatggcatatacaatgcctttatcagcaatatctgcaacgtgagatggtgtagttccagctgaagctcctaagtataagatttttgaatctctttttattggcataacctttaaacctttaattattgcagctgccaacttacttttatttggattccaaattctatactcttcatctccaatttttattattttttcatcatatactttttttcccttaacaatagattttgttgctattctttttaagccatctcctaaatcaacttcatagatgttttcaaaaatctctttgattttaatgtcttccattttatcaccaaaaaataataaatctaatgcaatataaataataacttatatgcatatatggtggtattgtggagtctatactatttattgcaattgcatttttaattaatagctttatctcctataaaataacaaatatgcaaccaaaaattaaaagtaggatttttaaaagagttaaaatgcactatcttaatttgattgaaggtaaaaaggcagagtttgataagaaagcaatgcctatattgtttggatttatgattattgctttaatttcctttaatattttattgtatgtggtttataattgtccagtttcaataacttcaataattgcagaaattcttattattatatcaatgattattatatggaaagcatttaacaaagaaatttctgtctatttgtgtgatgatggaatttattatagtaataaatttataagttggaaaaatattgagaatgttaaaaaagatgatgggtttatcgtattgttcggaaagaaaaagaaaatattaggacgaaaactttacttacttcaaagaatttatttaaaatatgatgaagaaattgaaaacatcattaaaaaccagatagaaaaatttagggataaagcatgaattttttgttatgtattttagcaataactttaatttatctcatgggattgattgtctttggattttgggattttataaaatttttatcaattaatagaggaaaattactaaaaagcttaaatgaacttatgggaatttagatttggaaaaagctttttatttattccaaattttattatgaaagttttagcatttgaagaactcgcactttttgatatttttgactctttaattaatgttaaaattaatatttatgagaatggaattgaatgtggattttctttttataaatgggatgaatttaaaggctataaaatagaagacaaatatataagattaattagcaaatttccattaataattagattgatatttgtaagagacatttacctaagatatgatgaagagcttgaaggtataatagaaaagcatctaagacaaaaataatgggagaatatggataaaatgtggattatatcaactgctattgtagttatagatgcattattgtatgttctgtatgtccattatcgtgaaaaaaataaaaatcgtaaaaagtaattatttcctactctttgtttttcctataactttcctttcttttttaccttttttatcttttttcttatccttttttttctttgatttttctttcttacctttcttttcttttttctttgctttaggtttctctttcttctttttctttggtggttttggatactttcttctaatctcttcaactctcttatttaacttttctaaaagttcatctgcaatataatccccaacataatcagctcttgcagctatagccaatttacatgctaaagctcttgctattttccctctttgccagtgtggagaaccttgaattaaagggtgattatatattataccatgttttggaggctccacacccatccttaaatgggcaaataaagccttctcagcacctaaaacttgtattgttgaagcaggcatcttagccaatttctccaatcctccagctaaacctattaatctcgctcctaaggaaacaccagcaagttttgtaatatttggagcttcttcgttcatcaatttttctaaatagttatatagctccttccttttttcatataggtgatttatttcctcagcaaatttaacaataacatctaaatcataatcttccaattctcctcccattgaattttttgcggcttcagcaattttcccagctaattttgaaggaaggattttttttagctgactcttggtaaagtttttcctttttcctaattttgttattaggttagcataaacttcatgtttattaactaagtggtctaactctgggaagtagagggaataccactctctcaatctctcagataacaagtttagagttttatccaaatcagatattgcctctgcaacttgaataatgattttatccttttgttgagcatagctctttataactttctttgttagctcagtgctccaataatgcatcttctttctaaattcatcatagttgttgaagtatcccaattcttttccaactttaaataagttgtttcttaaaaactcccctatattgaatggttcagtgctaagtgtttctaatttaatctcatctccccattcctcttttaactcatctgctattttatttggctgagtttttaatttaaacattatatctggaatttcttcctcattaaacaattttttatactctatatcttccaatccgctaacttctttattatctttaactccaaaagctccataaggtgtaaaagtaacataaatcaaaataatcccccctgataagtttttatatatagaacaacattaaaattttcttaaataaatagttttttgcaaaatgtcttatattagtaaagcataataatgaacgccttctttgaaggcgttcaatgttccttaataaattttaataactttgcaaaaaactattatactttcttactaaaaaagttctgtttggatgggatatttatgaacgttgaagagatggagagaaaattaaagccaaaaggagaagtttcaataattggatgcggaagattgggtgttagagtagcttttgatttattagaagttcatagaggtggggtagaaaaagtttatgtttttgataatgccaaaatagaagaaaatgatattgtccatagaagattagggggaaaggttggggaatacaaagtagattttataaagagattttttggaaatagagttgaggcatttagagaaaatataactaaagataatcttcatttaattaagggagatgtagcagtgatatgtatagctggtggagatacaatcccaacaacaaaggcaatcataaactactgtaaagagagaggaattaaaacaataggaactaatggggtatttggtatagaagaaaaaataaaggtttgtgatgccaaatatgcaaaaggcccagccaaatttttaaatttagatgaagaggggcatatagttgtaggaactgagaaatttatcagagattttgagccaataacaccatatacattagatgagattgctaaaaggatggttattgaatgtttaagaatattgtggagcaaatactataaaagttaaaaccataaaatttatatactacctctatatagtttatgtatgcaactcataggttttgaaagagccggggtagtctaggggctaggcagcggactgcagatccgccttacgtgggttcaaatcccacccccggctccatttgaaactttaagaaagtttcatcaaaatctgacacctcctcgcttacgctcggaggtgtaaattaagaggcattgcttccgttaggaagcaatgcatccgttttgatgaaacttttactaaaagtttcgtttaaatttcacccccggctccattttttatatttaactctcttctcttttttatagagttaaattttaaacctaaagatgtatctatcgataataataagatataaatataacctaatcaaattaatactaagcttgttttattggtttaaactacatatccttaaatagattttatgctacaaaaactcataatcttaaacacaaaataaatagattagaaagaaaatcaaaataaattaattaaaaaataattaagagaggtgcaaaaatggtaactgtctatgatgttccagctgataagttaattcagaagacagctgagaaattaaaagagatgaatataggagttccagaatgggtagattttgttaagacaggagttagcagagagagaagaccagaccaagatgactggtggtatataaggtgtgcatcaatcttaagaaaaatctatatttacggcccagtaggtgtttcaagattaagaactgcttacggaggaagaaaaaacagaggtcatgaaccagaacacttctacaaaggtagtggaaacatcattagaaaagctttacaagaattagaaaaattaggtttagttgaaaagacacctgagggaagagttgttactccaaaaggaagaagtttcttagacaacattgctaaagaggttagggatgaaataattaatgaaatccctgctcttgctaaatactaaggggatgctaaatggatgttgaagaaattaaaagaaaaaagcttcttgaattgcaaaaaaagcttgctgaacaacaacagcaagaagaggcattattagaggcggagatgcaaaaaagagctttattaaggaaaatattaacacctgaagcaagagagagattggagagaataagattggcaagaccagaatttgctgaagctgttgaagtccaactaatccaattagctcaacttggaagattaccaatcccattgagtgatgaggactttaaagctttactcgagagaataagtgcattgacaaagagaaagagagaaattaaaattgttagaaagtgaaacttatggatgttcatgttctctttagtggagggaaagatagctccctctctgcagtgatattaaaaaaacttggttacaatcctcatctaataactataaattttggtgttattccctcttataaattagctgaagaaactgctaaaattttaggatttaagcataaagttataactctcgatagaaaaattgttgaaaaagctgctgatatgattattgaacataaatatcctggccctgcaatacaatatgttcataaaactgtcttagaaattttggctgatgaatatagcattttagcggatgggacaagaagagatgatagagtcccaaagcttagctattcagagattcagagcttagagatgaggaaaaatatccaatatataaccccattaatgggttttggttataaaactttgaggcatttagcaagtgaattttttatattagaagagataaaaagtggaactaagttgagctctgactacgaggcagagattagacatatattgaaggagagaggagaaagtccagagaaatatttccctgaacataaacaaacaagggttgttggattaaaaaaggagatttaggtgagatgatgggaagcaacaagccattaggaaagaaggtaagattggctaaagcattaaagcagaatagaagagttccattgtttgtcattgttaaaacaagagggagagttagattccacccaaaaatgagatactggagaaggaagaaattgaaggcttaagtgaatggacattaattagggctgaaagccctaacttaatggacgagttttgatgaaacttttactaaaagtttcgaaggaagaaattaaaagcttaaatttgtttttcttttatataaaacacttctcctttgtagttttttagttttagctcttttattggcatctcattcaaaagaggtcttataattaaatttgcattaactttttttgataaatctaaaatatacggctgtaaatctcttggaggtcttatggaatatattaaatcaatatttttatataaacttatatttggattaaataaatcatctttataagcatttaatcccaacaatttagctttttcaatagctttttcattaatatctatggctatcaaatcnaaatatttacttaattctcttgcaacatcaaatttaaatccaattccaatctcagctatttttttacagttattttcttctgcgaacttttttataaactcaactattatcttaacattcattttttcacatctttgaaattttagaaacatttaaatataaatgtgaaaataaaaaattctgtccaatttggacttttatagtttcttgcaaaagttactgaagttcgtaaggaaggtttgaacaccttccttttggaaggtgttcataaatgtattatttattctaaaatgttttgcaagaaactatactttactttattaaactgggaggggaaatatgaactacaaatatctaatactttctttatttttaatagttggcgttttctttgctggatgcacacagcagatgaatgcagatgagatagcaaagaagatgcaggagaagtatgaggcaatgaagtcaatggaggcagatgttttaattacaacgaacataatggggcagacagagacgatgcaatacaaatatgcatttgaaaagccaaataagttttatatggaaaatgatgatgttttaattgtctgtgatgggaaaacttactatatgtatgataaaaagaaaaatcaatacacaaagatggagattaaaggagaattaaataatatgtttaaccctgactacggaaagtttataaaatcaatgcttgagaaatttaatgtttcataccttggagaaaaaacttatgatggaagaaaatgttatgttttagagctaatttctaaagaaaaccctgaagaaaagatgaagatgtatgttgatgaagagtattggcaacctctgaagatagagatggatggcgtaacaatagaatataagamcgttaaatttaatgtggatgttccagatgatagatttaagtttgttcctccagaaggagctaaattgatgagttctggagcaatgacaacatcaaaaaatatagatgaagttcaaaaggatgttagctttaaaatcttagttccaaaatacactgctgggcttgaattgcagaatgcaatggctacaaaacaaaatgccaataatgaagaatcagagacagtaattttaacttatggagaaaatggggagttggcaattattgaaagtaaggacaacaaacccttaacgattcctgaaaatggtagcaatttaataacattaaaaaatggagttaaagcattaatttcagacagtggagatgtaaaaatgttaatgtttgaatacaatggaataaaagtaataatagctggaaaattggataaaaatgagcttataaaaatagcaaactcaatgattgaataaaaaattttattttttatttttttaatcgtttgaaatacatgagattggcgattatgagggtgaaagtatggagttgagtcatgatacaaagaaccttttagatttagtaaaaaaagcatacgaaggggaagtagcactccctgattttcagagaaattttgtctggacaagacaagatatagaagaactaattaaatctcttttggaaaatatgtttataggaacttttttaatccaagaaataaatcctgaaaatccaccatttgggacaatctacattaggggggcagaggaattaaatcctaatataacattaagaaaaccaagaattttggttcttgatggtcagcaaagactaacgtcattattttatgcaatatatagcccaaattttccattaaaaaatactacaaaaccttatgcgttttttatagatttaaacaaattagttgaagatgatattgataattctgtttttagcctgtctaaagattgtagacaatataaagctttattaaatgaagataattctttcgatatagaaaaattaaaagaaaaaagatttttcccattaacatttttatcaaattcaaataaattttataagatatggtataagcattttagtgaaatttttcctgaagaagtatttaattatatgcataacatattggaatataaagttcctacactaattttaggattatcttacaatgataaacccgaacaagttgtagtgttattcgaaagaataaacaaaactggtataaaattatcgccttacgatttattggttgcaagattttataaatttataaaattaagggaaaagtgggcagaagcgtttgaaaataacattcgcattaaaaattttgcaggtgatgttgaggatacaaaagtgccttatatgtttattcaggcattagctttaagtaaaggaatgagcatcaagtcaagagatttaattaaaattgataactccattttaaatgatgaatcatggaatagagttgtagatattgctgaaaataaagtatttcaaagaatttttgatattagcgaatatggaattgcagatattaaaaaatggaatccatatacaccaacaataacgatgatgttggcattctttttaaaacatgatattccagatatggacaaagttaataaatggtattggagttcagtattttctgagagatactcgggttctacagaatccaagatgatgaaagattttaaagaagtttcacaatggattgagaacaataacaaaattccagaagtcgttgaaaacttaaagattgaaatacaatatggagcatacagtttaaagaaagttaaaagttctggaagttcaaaatataagggagtatttaatttgatatttaaaaataaaccaatggatttctataagcctgataatattgcctactataagcttgaagaccatcatatatttcctaaaggatttttaagaaataaaggcatatccaatgaatatatagattcagttttaaataaaacacccattcttgatgaaaccaataagaaaatctcaaaaaaatcaccatccaaatatgtcaaagaaatgatagaaattcagaaaaataaaggattatccgaagatgaagcagtaaataaagttaaagaaattctaaaagggcattttataaatgaagaaatgtttgaaattctaagaaataccgatgattcattatcaaaagatgaaattgaagagaactttaatagatttatagagcttagagaaaaattaatcttagagaaaatattggaattaatatcttaaaattttttattaattatcttctcagcaatttcctcaacttttttataaacttcattattttctggaagattccataaaggaatgccttttaaatcatactcagctatttccttattataaggaagcttcccaattaaattcaaaccaagctcttttgcatagttatcaattagctcttcatactctggtttaaccttatttgcaacaacatagatgtctttaaacttaacctccaactcattagctaattttttaattctctttgcagtccctaaacctctctttgatgcatcagttataacaatcatcacatcaacattttgggttgttcttctgctgagatgctctaagccagcctcagtgtctataacaacaaactcataatccttagctaagttatctataatctgcctaagccagttatttacactgcagtaacatccactaccttcaggccttcccataaccaataaatcataatattttgtctcaaccaaaatttcaaaaatcttactccttaaataatctaatttcgtcattcctgctggaatttcatccctctcaactaacttttttagctcttccctaatatctccaacagttttttctacttcaactcccaaagtttctggtagatttgagtctgggtctgcatcaacaaccaaaatactgtttgttttcttagataatgccttaattaataatgttgtaaatgctgtctttccaactccaccttttccactcacagcaataatcattttatgccaccacgaaaagtattattaattaataataattccttttagtgtttataaatggtgatgtcatgctatcaaaaaggctcttaaattttgaatcatttgaagttatggatattttagcattagcacaaaaattagagagtgaagggaagaaagttatacacttagagataggagagccagattttaacacaccaaaacctattgttgatgaaggaattaaatctttaaaagaaggaaaaacacactataccgacagtagaggtattttagagttaagagagaaaattagtgagctatataaagataaatacaaggcagatataatcccagataacataatcattactggagggagttctttagggctgttttttgctctatcttcaataatagatgatggagatgaggttttaattcaaaatccatgctatccatgctataagaattttatcagattcttaggagctaagccagtgttttgtgattttacagttgagagcttagaggaagctttatctgataaaacaaaggctataattataaactctccttcaaacccattgggagaagttatagatagagagatttatgaatttgcctatgaaaacatcccttatataatctctgatgaaatctacaatggcttagtttatgaagggaaatgctattcagcaattgaatttgatgaaaatttggaaaaaaccattttaattaatggattctctaagttgtatgcaatgactgggtggagaataggttatgttatatctaacgatgagattattgaagcaattttaaaattacagcagaatttatttatctctgctccaaccatatctcaatatgcggcattaaaggcgtttgagaaagaaactgaaagagaaataaacagcatgataaaagaatttgatagaaggaggagattagttttaaaatacgttaaagattttggatgggaggttaataatccaattggagcttactatgtatttccaaacattggagaagatggaagagagtttgcctataaattattgaaggagaaatttgttgctctaactccaggaataggctttggtagtaaagggaaaaactatataaggattagctatgccaactcctatgaaaacattaaagagggtttagagagaattaaggaatttttaaacaaatagataagcaaaaactttataaggggctaataatgaatagtaaaatagaaataataaaaattaaagctaaaaaacctattaacccaacaaagatacccggagcaaagtatgttataaatcaatatattggatgccaatatgcatgtaaatactgctatgcaagatttatgtgtaaatggtataattatggaaaatggggcagttgggttgttgttaaagaaaatctaccagatttaattaaaaacaaacacatcaaaggaaaaatatatatgagtagtgtttcagatgcctatcgaccgatagaaaaagattttaaactaacaaggaatatcttaaaaaatattgataagagggctgagctatctatactaacaaaatcagatttggttttgagagatatggatttatttaaaaagttcagcagtatagaggttggcttaaccattaacaactttgaaggaaatcttaaaaaagatattgagccgttctctccaagcaatgagaagagaatagatgccttaaaaacactctatgaaaacggcattaaaaactatgcctttatatctccaataatcccagatttgattgatgttgaatatataataggtgagacaaagccctttaccaacttttattactttgaatttttgaatttaaaggcaagcagagagtttaaacactacttagagcaaaactatccagagagttatgaaataattagcaataaaacagcatttaaaagatacatagatgaggtaataaataccataaagaagaaagatatagctattaaaggcatttgtgtgcattaataaaaacacattaatggtgatgcataatgaaagatgtattaaaaagggtctccgatgtagtatgggaattacctaaggattacaaagattgcatgagagttcctggaagaatctacttaaacgaaatcctattagatgagttagaaccagaggttttagaacaaatagcgaacgttgcatgcttgcctgggatttataagtattctatagctatgcctgatgtgcattacggttatgggttcgcgattggcggggtagcggcttttgaccaaagagaaggagttataagccctggaggggttggttttgatatcaactgccttacatcaaactcaaaaatattaacggatgatggatattacataaaattggaaaaactaaaagaaaaattggatttacatattaagatttataatacagaggagggagaaaagagttcaaacatattgtttgtctctgaaagatatgcagatgagaagataataaggataaaaacagaatctggaagagttttagagggaagtaaagaccatccagttttaacattaaacggttatgtaccaatgggcatgttaaaagaaggggatgatgtaatagtttatccttatgaaggggttgaatatgaagaaccgtctgatgagataatattagatgaggatgattttgcagagtatgataaacagattatcaaatatctaaaagatagagggttattaccacttagaatggacaacaaaaatattggtattattgcaagattgttaggttttgcatttggagatggaagtatagttaaagagaatggggatagagagaggttgtatgtggcattttatggaaagagagagacgcttattaaaattagagaagatttagagaaattaggaataaaagcttcaagaatatattcaaggaagagggaagttgagataagaaatgcctacggagatgaatatacaagcttgtgtgaagacaactctataaaaataacttcaaaggcatttgcattgttcatgcataaattgggaatgccaattggtaaaaagacagagcagatatacaaaatcccagagtggataaagaaagctccaaaatgggtaaagagaaacttcttagctggattgtttggagctgatggaagtagggcagtgtttaaaaactacacaccattaccaataaacttaacgatgtcaaagagtgaagagctaaaagaaaatatcttagagtttttaaatgaaattaagctattattggctgagtttgacattgaaagtatgatttatgagataaaatctttagatggtagagtttcatacagactggcaattgttggggaagagagcataaagaacttcttaggaagaataaactatgaatattcaggggagaaaaaagttattggattgttggcttatgaatacttaagaaggaaggatattgcaaaagaaattagaaaaaaatgtattaaaagagcaaaagaactttataaaaaaggagtaacagtctcagaaatgttaaagatggatgaatttagaaatgagtttataagcaaaagattaattgagagggcagtatatgaaaacttggatgaagatgatgtaagaatttcaacaaaattcccaaagtttgaggaatttattgaaaaatatggggttattggaggatttgtaatagacaagataaaggagattgaagaaatttcttatgattcaaaattgtatgatgttggaatagtaagcaaagaacacaacttcatagcaaatagcatagttgtccataactgtggagttaggcttataagaacaaatttaacaaaagaagaagttcaatcaaagataaaagagcttataaaaaccttattcaaaaatgtcccttctggtttgggaagtaagggaattttaaaattcagcaaaagtgttatggatgatgtattagaggaaggagttagatgggctgttaaagagggttatggatggaaggaagatttagagtttattgaagaacatggctgtttaaaagatgcagatgcttcctatgtctcagataaagcaaaagagagaggaagagttcaattaggaagtttaggaagtggaaaccacttcttagaagtgcagtatgttgaaaaggtatttgatgaggaagctgctgaaatatatggaatagaggaaaatcaagttgttgttttagtgcacaccggttcaagaggtttagggcatcaaatctgtactgattatttaagaattatggaaaaagcagccaaaaactatggaataaaacttccagatagacagttggcatgtgctccatttgaatcagaagaagggcagagttactttaaagcaatgtgctgtggagcaaactatgcatgggcaaatagacagatgattactcactgggttagagagagctttgaagaagtatttaaaatacatgctgaggatttagagatgaatattgtctatgatgtagcccacaacatagctaagaaagaagaacacataatagatggaaggaaggtaaaagttatagtgcatagaaaaggagctacaagggcattcccaccaaagcatgaggcaattccaaaagaatattggagtgttggacagccggttattattcctggagatatgggaaccgcctcttacttaatgagagggacagagattgctatgaaagagacgtttggttcaacggcacatggagccggtagaaagctaagtagggctaaggcattaaagttgtggaagggtaaagagatacaaagaagattggcagagatgggaatcgttgccatgagtgattcaaaggcagttatggcagaggaagcaccagaggcatataagagtgttgatttagtcgcagatacatgtcataaagctggaatatcattaaaagtagcaagaatgagaccattaggagttattaaaggataaacttcctctatttactatctattatttttaggtgtaagttttaaatatgactaacaattattttagcataacatcattatggattttttgtttttgctttttttattaattcattgagtaatgatattattttttaaatcttaaaaaggtgaaactatggataataacttagaaataaaagatttggaaaaaatagcaaaaaaggttagatataatattgtaaaaatggttggtttagcaaagtctggacatccaggtggaagtttatcagcaactgatattatagtagctctatactttaaactaatgaactactctccagataatccatataaaaaagatagagataggtttgttttaagtaaaggacatgctgctccagcattatatgcagttttgtctgagttgggtataatagaagaggaggagttatggaaattgagaagattggaagggaagttgcaaggacacccatcaatggatacaccaggagttgagatttgcaccggttcattgggacaaggtttttcagcagcagtaggaatggctttgggatgtagattagataagttaaacaactacgtttatgtcttattaggggatggagaatgtcaagagggtatagtttgggaagctgcaatggcagcagcccactacaagttggataacttaattgcctttattgatagaaataaactgcagatagatggatgtactgaggatgttatgagtttaggagatataaaagctaaatttgaggcatttggatgggatgtctttgaaatagatggacataactttgaagagattataaatactgtagaaaaagccaaaagcatgaaaaatggcaaaccaaagatgattattgcatataccgttaaaggtaagggagtttcattcatggagaataatgttgcattccatggaaaggctccaaatgaagaacaattaaaacaagcattagaagaattaagtgaataaaattttattttttggtgatttaaatgattaaaattggagcttcaatactatctgctgattttgggcatttaagggaggagattaaaaaggcagaggaagcaggggttgatttctttcatgttgatatgatggacggtcactttgtcccaaatataagcatgggaattggaattgcaaagcatgttaaaaagctaacagaactcccagtagaagtgcatttaatggtggaaaatgttgatttatttgttaatgaatttgaggagatggattatataacattccacatagaggcggttaagtttccttttagaattataaataggattaaaagtattggagctaagccgatagttgctttaaacccggcaacacctttggatgcaatagagtatattttgggagatgtttatgctgttttagttatgactgttgaacctggcttttctggacaaaagtttattccagtgatgacaaagaagattagaaagttaaagagcatgattgttgaaaatggatatgatacaaaaatattcgttgatggaggaataaatgttgaaacagctccattggcagtaaaagctggagctgatgttttagttgctgcatctgcaatatttggaaaggatgatgttaaaacagccgttaaaaacttaagagaggcagctttagaagctttaaacaaagattttttaactaaaagctttaattcaaatgaagaaaaacagtaaaaacaaaaataataaattaattattttgggtgaaaaatcatggttaagttgagtggagtttataaggggatgaggaaagggtatggagaaacattgatagagttagggaaaaagtatgaaaatttggtagttttagatgctgatttatctggttctacacaaacagccatgtttgctaaggaatttccagagaggtttttcaatgcaggagttgcagagcagaacatgattggaatggcagcgggattagcaacaactggtaagatagtttttgcttcgtcattctccatgtttgcatctggaagagcatgggagataataaggaatttagtggcatatccaaagttgaatgtgaagattgttgctactcatgctggaattacagttggagaggatggagcttcccatcagatgtgtgaggacatagctataatgagagcaatcccaaacatggttgttattgccccaactgattactatcacacaaaaaatgttattagaactatagcagagtataaaggccctgtttatgtaagaatgccaagaagagacactgagataatttatgaaaatgaggaggaagcaacatttgaaataggaaaaggaaagattttagttgatggagaggatttaaccattatagcaactggagaggaagtgccagaagctttaagggcaggagaaatattaaaggagaatggaatatcagctgagattgtggagatggctacaataaaaccaatagatgaggaaattattaaaaaatcaaaggattttgttgttactgttgaagaccatagcattataggaggtttaggaggagcagttgctgaggttattgcctcaaacggcttaaataaaaaactattaagaattggaattaatgatgtatttggaagaagtggaaaggcagatgaacttttaaaatactatggcttagatggggagagcatagctaagagaatcatggaagaaatgaaaaaagaataaaaataaaataaataaaataaaattattattctattttcaaataaacttttattgttgggattatgaaacttagatttattgagtgccatatacctaagcatttatttatgggaattgatgaaataagagaatgggatggggttatttgggctaatgttaaaacaaatgggacgatttcaactatacaaattttaacaacattaaaagatagtgagaagattgttgataaacttaaagagatgtatggaggggcaaattatagagttgttgtatttgaaccaactatgacttatccaccaattgaagaggaagaagagaaagaagaaccagagagactaattagggaagagctatataacatagcctcagatattgcaaatctaagtaaagaaaatatgttaatgcttatattatcaacaattgttgctatagctggaatttataaagatgatgtagccttattaatagcttcaatgattatagctcctttattagggccgaatatagctttatcactatcaattacagtagcagactataaattggcattaaaaagtataaagaccctaatagctgagctgatttttgttataattttatcaatgattgctgggcattatctgcctatatctttagataatccacagatacattcaagaattaccttagatttttggagtatcattattgcattatcggcagggattgctggaagtttatcaacggtatctaatatttcatcgattgctgttggagttatgattgctatagctttactgccaccattggctgtgtttggtttgctaataggggctggttatgttgagcagagtttttcagcattaattttatttttaataaatatgatagcaataaatttatctgccattgttatattctcagcttatggaatttctccatatagatggtggaaaaaagaggaagcaaggaaatatactctatatgcaatcttattatgggttacattatttatagcaatatttgtgctaataatttatcactaaattaaacatatatagttggagactataatttcataacaaacttttatcaatgattatggagggagagttatgaaaaaaggaactgacttattaaagaaaggatttgccaagatggttaagcatggggttgtaatggatgttaccaacgtagaacaagcacaaatagccgaagaggctggagctgttgcagttatggctttggagagagttcctgcggatattagggcagctggtggagttgcaagaatgtcagacccagctttaattgaagagataatggatgctgtctcaattccagttatggctaagtgtagaattggacatacaacagaggctttagttttagaggctattggagtagatatgattgatgaaagtgaagttttaacccaagcagacccattcttccacatatacaagaagaagtttaacgtcccatttgtctgtggagcaagaaacttaggagaggcagttagaagaatctgggaaggagcggcaatgataagaactaagggagaggcagggactggaaatatagttgaggcagttagacacatgagattgatgaatgaagctatagctcaattgcagagaatgacagatgaagaagtttatggagttgctaaattctatgctaacagatatgcagaattagctaagacagttagagagggaatggggttgccagcaactgttttagaaaatgagccaatctatgagggctttacactggctgagattattgatgggttgtatgaggttttattagaagttaaaaaattaggaagattgccagtagttaattttgcagctggtggggttgcaacaccggcagatgctgctttaatgatgcagcttggttctgatggagtatttgttggttcaggaatatttaaatcagaaaatccattggagagagcaagggcaattgttgaagctacttataactatgataagcctgatattgttgctgaagttagtaagaatttaggagaagctatgaaaggaatagatataactcaaataagcgaagctgagaaaatgcaatatagaggagattaaatttgaattttacttcatttttttaattttgttttaaaattttattgaaagattgtaaaaaatatatcaaaatatttaagtattcaataaaagttaaagagtgagattatgaaaatcacacgaatgcatggagctggaggaaaggtaatgcaggagcttataaaagatgtaatattgaaaaatttggagataacatcagttaatggaggaattggcttagaaagcttggatgattcagcaactatcccaataggtgataaggagattgtttttactgttgatggacacacagttaaaccaatattcttcccaggtggagatattggaagattggctgttagtggaactgtaaatgatttagcagttatgggagctaagccattagctctatctctatctttaataattccagaaggttttaacttagaagatttggagaaaatagttaaatcaataaacgaaacttctaaagaggctgaagtagcaataataacaggagatacaaaggtatctgatggagttgatgatatcataatctcaactgctggaatagggattgttgataggggaaaggcaataagggattgtaatgttcaagagggagatgcaataattgtttctggaaatataggagagcatggattagctattttattatcaagggagggatttgattttgaaacaaacataaaatcagatgtagctccaataaataaattaattgagagggttttagaagagggcattcaaataaatgccatgaaagaccctacaagaggaggtttggcagatgcgttaaatgagatggctgaaaagagtaatattggcataactatatttgaggataaaatcccaataagtgatgaagttcaatcaatttgtgatattcttggcttagaccctttaactatagcaaatgaaggaaaggtagttatggcagttaaaaaggaagatgctgaaagatgcttagagattttaagggagcatccattaggaaagaatgctgaaatcattggctatgctacaaaagaacataagggagttataatagagacgattgttggtagaaggatagtggatatgcctattggcgatccgataccaagagtttgttaatattcataatgcaatttttaaaagttttgatgaaacttttctaaaagtttcatgcgagacatattgttggtaggagaattgtcgatatgccgattggagacccaataccaagggtctgttaatcttctgtaatattttccttattttggtgaaataatgaaaatcattggaaaaattggaaaaggtaaagtagaagttaatgaaaagacgaagttctcaatacttttaaacaatgttgctaaaaaagctgatattgctgagggaaaaagagctgttgaagatataattagagttatctataggcatcagccaatatcaacaaaaaagattgctcaaaaaacgagattgcccttaccaatagttgccaaggttagaactatcttagagagagaaaaaatattaaagagaactgaaagaggagcagagctaacagatttgggtaaagaatttgctgaaaactttttaaaattgaagtataaaaaatctcttacctgcaaaacttgtaatggtagaggtattgtgttagatgaattttttgaagatattttaaataaggttagagtttgggctaagagaaggcctttagttgatacaactatagaccaatcctttgcaacaccagaaacatcaacttatagggctgctttgatgtatgaaagaggagatttagaaggaaagagaattttatttgttggagatgatgacttaacttctttaccaaccgctctaacaaatatggctgaggaaatagctgttgtggatatagatgagaggattttaaagcttatagaaaaattttcacaaaaagaaggagttaaaattaaaacaattaagcatgatttaagaaacccactaccacaagatttaaaggagagatttgatgttatctcaacagacccgccatatactgttgatggcttaaagttatttttatcaagagggatagaagcgttaggaaaagaagggattgcttatctttcctattctcacaaaccaatagatgagtggctctctattcaaaaagcaattacaaatatgggttttgttatctcagagttaattccaaacyttaattattatgaaggtagtgagataattgcaaacacaacatttatagcgagattggttgggaaaaatttgaagataaatattggagacactgagaagatatatactggtttagttaagccagttataagatattataaatgcctaaaatgtggaaaaatccataaagttggagaagaggttaagaaagttgaggatttagtttgtgagtgtggagggaagaaatttaaaatgattaagagggaaaagttgaaaaatgaataattaaaaanttaatcatagattaaatctaaattatatttctctgccaactccaatgccttctctatctcttcataagttaatcttctatttatatcaggatattccttagctttatattctgggcgatactgaaacataacattaactacagcgttatctaaattttttgagatgaagtcaaatattttctctgtgcaacaatctaagtggtttggcattactaaatgccttattataacttcctcatcttttataagcaagtgattcctcttaattatatcaaaatagtttttaacttttgataatctttctccacattcattatttccaaacttaaagtcagttaaatagacatcaacaactccttttaataaatgcattccttcaacagttagatacatatttgaattccaaactaccgggatgtttttatctaaatagcttagagtttttaaaatactcaataaatgtggtgtagggtctccaccaacaaaattaacgttttttgaataatctcttttatgtttaataattttagccatttcttttggattatatggaatacagtggttaggaattgttttatcaaaataaacctgagatatatcccagttctggcagaagacacatttaaaattacagccacagaagaagattgtatgtgatggaactaaaactctttcttcaccgagatgtagaaattctgttgagtaatagctctcttttatcctacagaaacctctttcagtttctctatttacataacatctatgctcacaaaaatggcaatttttaaagatatttttggcaatctctacttttaagtccaataggtttggttttacatactctaaatcattaaaatcaaaattatcaaaatctacttttttcaagaccttgttatggatttcccataattcatttagttctaatcccttaaattcttcaacttctatacacttagctattataaactttgctggggctaaatcttttgaaaccgctaaatatctaccaagtttcataatctcacatcagttgagtaattaatttaaatagataaattatatgaagtataaaaaattaaaaattaagcttgaaaaatttattccttaattaatattgcattaacagttccatcctgcccaggtcttgatgtaacttttgccaatccaatctctgtttcaataattgctccttttgttataacgtttcttctgacatagtggatgtttgccttgttttctctaactgttattatcttaactttcttacaagttcctgtttctgggtctaatacgttagcaaatcctgttctaacaaccttaacctttaagtttcctcctcttgttctaaccttttttattttaaatgcctcttctgctacgtgtgtttctattggttctctacccatttcatattttctcttttttctcgctggtctatacaacccacctgttggttttcttctacttcttccttgccatacactcatattaacacctgtaataattgtttttaatattttttaactggatttctttcttattattttattatttccatgccttttggttagtttattccaaatacttcataaattctataatttttactttaagttttgttttgtaaaagagacacgggtcaggccatgcgagtctatgaataatgaataaacatacaagagatataaaaacttaactattaacatacctaagttataaagtaaagaaataaatctggtgggggagggatatgagattatccaaagaatttataggcttagggataattacagcttctcttatttttggctcatctttaccagatatatacaaaggtattgttatattaatagttgctggatgtttatggttttttgaattattgcctcttccagttacatccttagcaataccaataatggcagtgtttttaggaatttttaatttaaaagaggctttaacatactttgcccatccaataatatttttgtttttgggaggatttatgcttgcacaggcattaaaaaatcataacttagataaatttattgcctataagctactaaattatggaaaggattttaaaactacatgttttttaatgtttctatcggcttattttctatcaatgtggattagtaacacctctgccacattaattttgttgcccatagctcttggtctattacataaaaaaactggtaaattgagagattttttattgttaggagttgcttattctgcctctataggaggaatagcaacaattatcggctctccaccaaatgccatagcaagtagctatctagattatggattttttagctggtttaaagtgggatttccaataagtttattgttatttttgatttgtactttaacattatatatttactttaaaaagtggattccaaaagaagatattgctattcaagcaagaatggagttgagtagaaacgcttataaattattggtcatatttgtgttaatagcttcactttggataattagcgactatttgagtgaaatttttaatgtccaatattttgattcagttattgccatattcgccataattttattgtttgtatttaatttagttgaagttaatgattttaagaaaatagattggggaactttaattttatttggtggagctttatgtttgggaggagttattgttaagagtggagcaaatacattcttatctgaaaaacttatagctatcttaggaaatttaactccaattgttcttttatttttagtagttacaataacaataattctaactaattttataagcaacactggattgactggaataatagtcccaatactatttggagtatctttaggaattccaaaagagattttaatactggctgttggtatgtcagcatcgtgctcttttattctgccagtagggactcctcccaacgctattgtatatagtgaaggtgtcaaaaaagaagaaatgatgaaaattgggatgattttatcaatactatctgcagctgtaataactctatattccattctttatctataaaatttagctatcatttagaatataaaacttaaattttattaactaaacatttaaaattggtgatggtaatggaaaaaaagccatacattatctcaaatgtaggcatgaccttagatggaaagttagctactataaacaacgattcgagaatttcatgcgaagaggatttaataagagttcataagattagggctaatgtagatgggattatggttggtattgggactgttttaaaggacgacccaagattaacagttcataagattaaaagtgatagaaatcctgttagaatagttgttgatagtaagctaagagttccattaaatgcaagggttttaaataaagatgctaaaactattatagcaacaacagaagatactaatgaagagaaagaaaagaaaataaaaatcttagaagatatgggagttgaagtagttaaatgtggtagaggaaaggtagatttaaaaaaattgatggatattttatatgataaagggataaaaagcatcttattggaaggaggaggaactttaaactggggtatgtttaaagagggcttagttgatgaggtctccgtctatatagctccaaaaatatttggtgggaaagaagccccaacatatgtagatggggaagggtttaaaacagtagatgagtgtgttaaattagaattaaaaaacttctataggttaggagaaggaattgtattggaatttaaagtaaagaaataaatataatgtgagagttatgcttccaaacaaaaaagccttagaaattattagaaagtatatgaaaatttacaatggaaagaatgaaaaagatattaaagagagattaattaaagagttaaaggaagaacatgtcttagtagaaactgaggatggaacttacactttaaaggcagaggatgaagaggagatgatgcattcaaaggttggagctttaaaagaagcaatttataagtttgctaagccatcaaagataactgatttaagcaatccaagagttttggatttgtgcagtggtatgggatacaatgctatagctgctttacattataacaaaaatgcagagattgatatggttgagatttgtgaggaagttttatttttaactttatttttagatattccatataaagagcatgagattataaaagataaagttagagagtattttttaaataaaattggcattgaatataagtcagattatgataatatcaatctatacgttggagatgcgagaaaatttataataaagagtgataaaaaatacaatgtggtttttcacgatgcattttcaccaaaaagagaccctaccctctacacttacgattttttgaaagaaatttataaaagaatggaagataatggagttttgatatcttactcttcagccattccatttagaagtgctttggttgattgtggttttgtaatttcagaaaaggagagtgttgggagaaaaagaggaataaccttagcttataaaaacccaaattttaaaccaaatagaattaatgaggttgatgagagagttatagctttatcagttatagctttaccttatagggatgaaacattaagcttaactaaagataaaataatagaggatagagaggaaagaagagaaaagttaaaagaaaaattaattaaaataggaaaatatctatcaacaaaacagataaaaaaaggtaacatcccagaagaaattttaaaaattcaaaaagaggatttaaactcatcagaaataattaaaaagatgagattgaagtttttcaaagatgcaaacatttttatactataagcccatagttgttgaggatgctaaaatctctttttagcatctttaaaaattaaattttattggaagtggaatatatgaattttaacgaattaaatttgtcagataatatcttaaatgccattagaaataaaggttttgaaaagccaacagatattcagatgaaagtcatcccactatttttaaatgatgaatataacattgtagctcaagcaagaactggaagtgggaaaactgcttcgtttgcaattccattaattgagctcgttaatgaaaacaatggaatagaggcaattattttaactcctacaagagaattagctatacaagtggctgatgagatagagtcattaaaaggtaacaaaaatttaaagattgccaaaatttatggtggaaaagctatatatccacaaattaaggctttaaaaaatgccaatatagttgttggaactccaggaagaattttagaccacataaatagaggaactttaaatttaaaaaatgttaaatattttatattggatgaggcagatgaaatgctcaatatgggttttattaaggacgttgaaaagattttaaatgcctgtaataaagacaagaggattttgttgttctctgctactatgccaagggagatattaaatttggctaaaaagtatatgggagattatagctttataaaagctaagataaacgcaaatattgaacagagttatgttgaagttaatgaaaatgagagatttgaagctttatgcagacttttaaaaaataaagaattttatggattagttttttgtaaaactaagagagatactaaagaattggcaagtatgttgagagatattggatttaaagctggagcaattcatggagatttaagtcaatctcaaagggagaaggttataagattgtttaaacaaaaaaagattaggattttaattgccactgatgttatgagtagagggatagatgtcaatgatttaaactgtgtaattaactaccatcttccacaaaatcctgaatcttatatgcatagaattggaagaactgggagagctggaaagaaagggaaggcaatatcaattataaatagaagggaatataaaaaactgagatatatagagagagcaatgaaattgaaaatcaagaaattaaaatttggataaatcttttttatttttgctattgataaattttattttatttattttaaattaatatatcacccataggcacttgcataaccacatatacagaacaaaaaattcataaatactttttaactaaatattacaaattagatataattgttattttattgttgttttatatgttgttttttttggtggttattatggaaaacgatgaaaaaattattgaagatttaaaaattattaatagcaaagcaaaatttgttggaattaaaattcttatgataaggcatattattgaatcccatatgaaagataagaaatcaatatataaaatcttagaatctacaaaaaacacagaattatataagttaattttaattgcatgtcctaaattagaagaaattaatgaagaatcaaattaaattaatagaacttttaataaatgttttattgaaatatgatgtcttttggtatttaagttcaaacagaattgtatataaactgcgggaaggtcctatttagaatcttgaaattttttggagtaacatgccctcaactttgattggatacaatattcttgctaatttaatagctgattttagcctttcttcagagtcagagtatatggtgtataaaacatctcctttttcaactttatttcctacttttacgtttagatagataccagcttttttatcatttggagctccagcttctttggcaatttttgtaattccagcatttgatattcttgtaacatacccatcaattggtgagtgaatatcagctttatattttccaacctcaatttcatctgaactaacttcttttcctccctgagctacaataatctccataaatttgtcatgtgccttccctcttgctaataaatcttcagctaactctttaccttctccagtaggagctactcctcccatctctaacaaaattccagctaatgaaatagatttctcaacaaggcttgtaggggcttgagtataatcttccaaagccaataatgcctcttttgcttctaaagctggaccaatagctcttccaattggctgtcctccgtaagttatagcacattcagtaactatcctcaatctatcactcaattcaataaacttccttgctaagcttgatgcctcttttatagatttaacttttgctccatatcctgttggaatatcaatcaatagcttattaacacccatagctaatttttttgccatgacacttgataataataagggctctgggtctatgccaagaggtctttcaacatttattgttatatcatctgcaggagctaaatctaaagcccctccccataccatacaaccgtttgtttctttaacaactctttttatttcttcaatggttaaatccactcttgttaaaacttcaacaacatctgctgttcctgccgctgaagttattgcccttgaagatgtttttggaatctttaagccagcagaggcaactattggcacgactaataaagcatatttgtttccaggaactcctccaattgaatgcacgtcaaatatatgcccctcccaattaaccatctctccagtttcagccattctaattgtcattgcttcaatctcatccatatccattccatttatatataatgaggtgacaaaggcagatatttcaatatttgttagctttccatccaccatctcatctataatttcaaaaatttcctctttttttaatttatttccatccatcttttttcttatatatgggagagatttaggtttttcagcatgttttattgtaacaatatccccttctttaacacctaactctttaactactttttgtggaagccctatttctcctctgtttatcaatgtggttgaagaatgtaggattccaataacttcttttcctttaaactccacaactactctatcttgagggaaatactgagagctttttaagtcttcagaattaattaaaaccaaattctccaagtcaatatctaaaactctaacttttagaaatagcatttaaatcaccactaatttctttatctattaaatttttatattttctaaactttatatattttctttaatattacttctcattggtgaaaacatgaagcttataaaaaatttaatgcccttaaaaagtgctgaaaagattgtttttgaaaaattatcagagtatttggatgagaataaaaaagttaaagaagttgatattgttgaagctttaaacaggatatctgctgaagatattaaagctccaattgatttaccttattttaataaggctgcgatggatggttatgctgttatagcggaagatacttttggagcttctgaaacaaacccaataatactaaatcttgctgatggagatgaaataacttatggagaagctaaaaaaatattcactggagataaactaccaaaaaatgccaatgctgttgttatgaaagagttttgcaatgaagttgatgattttgttgaagtttataaaactgttcatccaaacgaaaatgtctcaaggattggggaggatgttaaaaagggagatgtagttttgaaaaagggggagattattaatccttatcatctaaatatgctcgcatctttaggaattaaaaaaattaaggtttatgatttaagttttggtataatatctacgggagatgagctcatcaatttggatgaaattagggatattgaggaagatattagtaaattagatgggaaaattataaattccaattcatatatgttatatggtttagtaaaaaatcttgggtttaatgcaaaaatttatgatattgttaaagatgataaagaaaaactaaagaaagctattaaaacagctttgagtgaaaatgacgctttattaataactggaggaacttctgtgagtgagagagatataactgttgagactgtcagagaattgggagatgttatagttcatggtgtaaatataagacctggaaaaccatttggatttggaataattaatgataaaccagtcttcatgctgtctggctatcctgtagcttcagctgttcaatttgagttatttattcaaagattttttatagaaaggaagaaagttaccttacctttaaaaagaaatatggcctctgagcttggtagagttgattttgttagagttaaggtggatatagaagtagaacctataagaattactggaagtggagttatttcctcgttaataaaaagtgacggctatatcttaattccagaaaatgttgaaggttatgaaaaaggagagcttgtagatgtgtatttgctaaaatgattatttataattattgatgggtgattaacttggatgtgtggattgatttaacaaccatagggcttcgccctattgggatatccagagcgggattgcctttggcaaccccactttctatttggaggtgtgtcccaatagaggggctatatcccctctatagtgcgatacccagagggaactctacgttcaacccacttaaatatatttaatgggtgattaacttggatgtatggattgatttaacaaacgccccccatgtgcattatttctgccaattgataaaaaaatttgagaaagaagggattgagtatttattaacttttagagattcagggaatttagctaaattagttgaaatttacaattttgtagggaagtgtataggaaagcatggaaacacgttgaaggataagttaattttctacgctgagagggttattggattaactgaactaatatcaaatgtaaagccaaaagtagctatagcaaaacactccgttgagttgccaagggtagcttttggtttgaacattccagtaatctttgttgtagataatgaacacgctgaagctcaaaataaattaactctaccattggcagatgagattattaaacctatagcaacagatgaaaataagctgaaagaatttggaggaagaaattttataagctttgaaggaacttgtgaagtggcaaatgtaaattcacggctaaagggttattatccaatagataatgaaattttaaaaaaattgggaatttgtgatgataatccaacaatagttatgagaccttgcccaaactcttcttattgtaatggacataaagatatactaccaaaaattattgaaaagcttcaaaaaagaattgactgtaatatagttgtgttcccaagggatgaacatcaaaaagagatatatagagaggttaatgctatagttccaaaagagacaatagatgctctttctttattgtataattccgatttcatgattggtgctggaggaacgatgaacagggaaagtgctatcttaggcattccaacggtatcttgctatcctcaagagttacttggagttgataaatatttaattgaaaaagataggatgattcatacaaatgatatcaaggaaataataaactatgttgaagataatttaggaaaaagaatgggtgttattgagttagaagacccaactgatttaatgtttgaaagggtttgtaattatttaaaataaatattaaatattaatttttctttggaaatcttctatatagacagtttggataatttgtgcatcccaagaactctcctttttttgttctaactactctcaacttagctccacaccatgggcaagtgttatcatctatctttgacattatatccaatatagctggatttttattacacaatctctctttattgtaaattattttattgtttatggtatcaacatatacaatgaagtttttaaacaagtgagagttttctaaatcaattataactctaccattattgatttttattccgggtgttatttgcatatttgtttttattggtattaaataataaccttgcccagaatactctaaaattcccatattatattttatccttccaattaaccaattgtaatctctattagcaacgaatcttattgtttcatcaatattgtcaaacatatttttctcttttatattgttaagaacttctttaatgaaattgtcttcttcatagcccttagtgagcatttctatagctttttcaataaactcagttttatcaaattttattaataataagagtccgttaaatgcattagcaacaacatacttttctttttcaataatatctctcctgtcaaatatgtagtagattcttgcaaaaatctgtttctgaccttttggtgaaatcacttttttaatttcaaattcttttttatatgaatttgttattccatagtaaaatactggcattttagcattttcaattcctattattgatataaacccctctggaactttccaattttgttcataagtttcagaattcagtttagtggcattgaagtgtaaatcttttgataaaatttcaaataattcatttaaaacttctcccatattatccctccgtaaaactaaatttttcaaattttataaaattaaattgttaaatttaaatatttggtttaggcaatggctcgttttctgtttcaacaaccaccaataacggcttattcttttttaaatagcctttaatttctgaaccaatttcatcaacattttcaatgtagcaattatctatttcaaatgcatcagctattttgttgaagtttggattttttatcttgcagaactctgccaaactgttatttttcatcacaaccattaagatttttaagttattttcagctacaacttgcaactcctcaacattcatcaaaaatccgccatccccactaattaatacaacttctctatcgatgttgaaatctatagttccaaattttactccaatggatgcaggcaaaccaaaacccatagttccaaatgagtgtgaggaaatgatatttcttggaataacgcaggtttttaataagcaggtaaatacagtatgcttaccagcatctgtaactattatggcatcttctggaatatttttaataatctcatagattttgtttgagtaatctccagaaggctgaaatttgttgctatttttatatatccagctactattttttacatctaaattttcaaaaaattcttttaactctttgatgctttttggttttagttgtatattttcagttttacttaaaagcttttccctaacactctctacataggtgttgtaagatagagatgagccgatatttattatcttatctgcctctaacaaagattttaaatcccctctcctcccaactaagcctatgcagttctctaatttttcattaataactcctctcgctggaaatgttgtagctatgggacagtttatcttttctaatatttttgatatttttactatctctttataacttaaagtcccaaatataccctgcccaattaaaaatagtggttttttgacatctatttcttttatgttgttggaaggagtttcatcatctttatatatatctgtatatgtggttatatttatatcttttgcttcttccttgtataaatcaactggaatatttagctgaacaggttttttattaaataggcagtcagcaaatgcttttgctatataacttacttcagctttatcaacaaaatatcctttataaaaatttaaaaaatccatatttacctcttgaaaataatttttgccaatatattttctctgacatcttccagtaattgccaatacagatgaattatccttataggctgttgctattggcgttgttaaattcgtagctccaggacctgcagtagctaagcaaactcctatatagttagttattcttgcatagccatcagccatgaaccctgctcctctctcatccctaaccataatattttttatactgctaccctctatttcattatacaacggcaatatctgctctcccggataggaaaatatagtttttacatttctttctaagaaatctaccatagcttctaagaatttaatattaccacccacaaaaatattgatttaaacggtgagattgtggataaaaggattttagttagattggcaatctatcctatcgcctatgtcttatggggcgggttgatgtggtattctcaaattataactccacttgatgtaacaaatttgttattaaagcttcccttatgcaataaagaattttatatatttttacagtcattaccaaatattgttattgaattttttaaaattatttatttatatggattttcttctatgattattggaggtatcgcctattatctatttataaagagagattttttgaagagtgatattattttaattgacttagctttaggttggctgtttgctggtttaatatacacctttgtcgttgtaaaatctccatttcaggtaggtgttgctaaggatttaataaatatgcattatttttggatatttacaaaaccaacatacgaaattccatcattgcatacagcatattcttttttgttagcattacattttaaagatgaaaagccattaaattatatttattttgcactggcgatattaattccaatttcaactctaattatgggaatgcactggattgttgatgtcattacaggggttttatatggttatattatatataaattccctaaaaccattcatataaaaattagtaaagcacttgattttttagctggacatataaaaccatgtattttatgtggaaagtgtaaggagagggaaactcatgaaaaataagaaaataaaatttgatgtctatttgaatggaatagcttatcattgtataaaatgcggattctgctgtgatgctccaactgttacaaaaaaggacttggctaaaatagctggttatctaaaaataccatttgatgaggttttaaagcgatatgttagattttttaatggatatattggtgagcttaaagaagttggaggaaaatgcatatttttagataaaaaaaccaaaaaatgtaaaatttataaagttaggcctttaatttgtaggttaagaccttactcagtccaagttagaaatggaaaattaactttaacctatgatatatggtttttaaggtattgtagagggctttatttgggagatggtaaagttgaggatgaatactttaaatatgctgaacttgttttaaaatacttaggatttgaggagggtgttgatgaagaagagtttaaaagggctaaagagaggttattggaagaatctttaaagtatagaaaaaagaaagattaaacctttttatttatagttgtgtaaaaatataaaaatatttgcacatccataagtatttataccccttttgacaaggttgttattgagcgaaatgcgatgaatccttaaataaatttggtgaattgaatgtttaataataaaggaagaagaaatgtaagaaataatgaagttagaagaaatgttccagttaaagaaggcgaaacctacactgttacaattgaagatatgggtagaggcggagacggaatagcaagagttgaaggattcgttgtcttcgtccctgaaacacaaaaaggagaaacagtcaatgtaaaaataactgctgtaaaaagtaagtttgcatttgcagaaaaaatttaaaatctctttaaggtttagctaaacctttcaatacttttttcattttgagaaacaatttaaagattaacaaaattaattattaattagagtttattttcctaattcatccaataaagcgttgataattgccattaatattccttctttaattgcccttgacttaattttttcagcaacttttaatgcttctctgtatttctttatttctattaatttcatagctattttttccaaatcagtttctgtcttaattttctccactaaagccattgctttgtctatttctccattttcaatgtatgcaatagcaacctttctcaaaacctcatctttcaatccaaaacttgatatcttctctgcaactttaacagcttcatcgcagtaacctttttctattaaagttaaagcaattatctctaactgagcgtctccttttatttcttcaacttttttaaggacttcttctatttttccttcctcaattaattttattatttcactaaccatttttattcaccattttagaatttttattcatgttttttacattatctactatgtatccacttgatatatataatttactattttgtgtaaatttatgtcataatattggacatctataaatataaaaattaaaaaagttaaatcggattatataaatttataaaacttcccagtatagccaagagattttaaaaaagcaatatcatcattatttaactcatatttttttgttggaggaacttctttcccatcccttgcatatataactccttcttttttcttagcgcccaagtatttccctgcattaccatcaacaactattatcccatctctcatttcaaaacctgtgaagtcattagtatttccgttaattataacagttccaccatttaaaacagccccagtattttttccagcatttccattaacaataacctttccctttctcattaaaattccagtggataaatcaacatctccattaactacaattgttttatcttcatttaaccttgctccaacagtatctctttttattttatcattaatctctaaaattcctttatttttatcaaatttatttggttttagaagcttctcttctttatatctctcttcaacaaactctgttatggatataaatttcctatatccttttatatcgctttcaacttcaataacattccccatcggctcttttatcttatttttttcattaatatagacggttccagacaacatgcttattccaaatcttgtatcgacatctccatccactataacagttcctacttttatcctttctccacttccactaaaatattttaaatcaacgcccatagaggagcagaatcttttccctacatttcctttaatataaactacccctccattctttaaatgctctacaagggttttaaaggtaatattttcttttatctcagtttctggattgaatttactctgccatataaagttgtaggtaaagtcgcataagcaatctactggtttatctaacttcaatgttaaaactttatctttattttcatttaaaaactcatccaatttctttttattggattttttgaagatgttgaatagcataaaccccaccaaaattttatttgttcaatcttatttttgttttaaattgttatttaaagtttctatatttgtaaatttaaatttacaaatatagtttcaaaataaaaataaaaaagaagaaaataagaattgatttattcttccttcaataatcctgcagcatctaaagctaatttaacttcttctgttgaagctccttttgggatatcaactttcttttctgttggttctaagtgttttatgttgcatcttcttctcttaactaacccatcaactataacgaagtttttatctaagatatctacgataacacaaacttttcctgcttctcttcctgctgtttttatacaaactcttcctacttcaatagctggcatttacctcacctcatttttgttgttgtgactctcgcgaatcacaactcatcctccaatgagggaggtttaatatcgccccctcgtttttatttttttaagttatcaatagcagaggagacaatattaaacactccctccacgtcccattttgaagtatcaataactaaatcgtaaatagataagtcatctaaatctatattataaatttctttatatctttttttctcacttgcttctctttcaatcatcttttttaaagcaacgtctttatctatattttctctcttgctaattctttcagctctgacttcaaggggggctttaaaccagattgttaaatctggcttaattccattttttaaaagcatccatgcggctaatcttccctctaatacaacatttccctgctttgctatctctacctgtcttctgtctatttcttcatcaatctctttatgctgttctgcatacttgctgaattcctgtaaatccattcccatctcttttgccatctctctaaatatgaatcctgcacatacgtgtcttaagttatatttctctgctatcatctttgcaattgttgtagttcctgtccctggcagccccccaatggtgattatcatctattcacccatccaaaatggatttaattagtataaatattttttcattgtaattttgatggcattaattaaaataattttaattaatttagaggtttcttgccttctgaatcatcaatctctttaagcatcttgggcataagtagcctccgtaaggtctctctggtcttctctgtgattttggtaattttcttatctcaacaggccttcctcttggaactccgtgtaattcagctccacatatagcacattttggtttgcctggctttcttctcttataatggataactattcttcctcctggtgttcttctgtatattcttctgtatgaccttgacctgtatcttggtgctggcatgtttaactcaccttttagtatgaattttgatagtattagaattagcttcttattattatcaaaaaatcgtaatcatagtgtgtatttctataatgttttcttaatttttaatttaccattaaaaatttaatatcataataccataagaattagtatttaaaacttttggttgggtgaatgtatgttgaaaacaaacatctgtggaatagaatttaaaaatcctgtttttttagcaagtggaataatgggagaaactggaagtgcattaaaaagaattgctaaaggaggagctggagctgtaacaacaaaatctattggattaaatccaaatcctggacataaaaatccaactattgtagaggtttatggaggatttttaaatgccatgggtttgcctaatcctggagttgatgagtatttggaggagatagaaaaggttagagatgagttaaataggatggatgttagaattattggctcaatctatgggaaagatgaggaagaatttgctgaagtagctaagaaaatggagaggtatgtagatattattgagctaaacatttcctgccctcatgctaaaggttatggagctaccatagggcaaaatccagatttgtcctatgatgtttgcaaggcagttaaaaaagctgttaaaattccagtttttgctaaattaacaccaaatgttacagatattattgagattgctcaggcagttgtagatgctggtgttgatggattagtagctataaacacagttagaggaatggctatagatattagagcaaaaaaaccaattttagctaataaatttggaggcttaagtgggaaagcaataaagtcaattggaataaaagtagtttgggatttgtatgagaattttgatgtgccaattatcggtgttggaggaattatgagtggagaggatgccattgagtatatgatggctggagcttcagctgttcaaataggaagtggagtttattatagaggttatgatatatttaaaaaagtttgtgatgaaataataagctttttaaaagaggaaaatttaacattggaagagattgttgggatggctcatgaataattttttaatatttagttcttttcaaaaagttgttaaattttattccaaaatgttttgtaaagaactatttattcttctttttcttcaaattcttctatgcattcatcgcataggtatcttccttgatataacctaactcttccttgataaccacagttttcacaaattccatttatatactcttcactaaactcatcggtatctaatgaaataacttctttttcttctggtgttattgatgcatactctataactatttccaacaactctggagatactctaactatatcgctctgtgtaactattccaaccaactctccatctttcacaactggtaatcttttaatcccatgagttgccataattttagctgcttcagtaattgaagcattttgagggattgtaataatctttttactcatcacttcctcagccaatacatcctttggctttaaattttttgaaacaactctctttacaatatctctttctgttacaataccaattggtttattgttttctacaataacaacagctcctatattattttctgtcattatattggctatatcgtagattgacatattttttgtggctttaattactggaaaactcatgacttctgaaacagggatgtcacatgcgattttcataaccccaccctaaaagttttctaataaagaaaatataaaacattataatggtttatatatattttattatttatacaatgaggttgttaagttaacgacttcatccaattgtagaacattatgaagctttttatccaactaacaaccgtatcgaatttactattacttggaaatctatttaaaacctctttaatcttgtgataataaattctaatcgattcgtgacttatatcttcgaatttggagggggataaaccacttttctcaatgataatccgaggtagtataaaagccctgctaagattttaacctctatcgattcctattccttttaaaaagcttcctctctacgattttcttctttataacttctatcatgagcctcatagtttattattttttatcaatatttaataaaaaacttaacttgacagtttcgtctcaggataacattagatatatatacctttaaaatcataccttacattaactatttttaatcttaataatatataataaatttacagtaataaaattaaaaactatttttggtgatatttatgacagaagaacaaaaaagaaaacttactggaaaaatgaagagaatgcttagagctaaagctcatcatttagaacctgttgtatgggttggaaaagagggaagtgaaaaggttattaaagaagtagatagacagttaaaagagagaggtttaataaaggttaaagtaagaaaagctgctttattgtatgaagataaatatgaaattgctgaaaagcttgctaaggcatgtgatgcagaggttgttagtgtagtaggacatgttataaccttatttagaccaagagaaggttggaagaaatatttagctaaaaaaccaaagaaaaaggttaaaaaggatgaaaagattattgaattatttgagaagtttaagaagaaggcagttaaagaataaataattgagggagataatgaaaaaaatttatatcattcttctaattctttttgtgattttaattagtttaataggggcaagtatattattagttatgagcttatcaggagaaaatgtcgatttgtttggtggggaaaaaatagccaaggtttatttatgcaatgaaatctattttgattataatcaaggagatggaatctttccacaacaaaaaaaagatgcaagatattatataaatttattagatgatttagagaaggacgattcagttaaaggggttttattggttgttaattctcccggaggagaggttatagcaagtgagaaattagcaagaaaggttgaagaacttgcaaagaaaaagccagtagttgtttatgttgagggcttagatgcttctggtgcttatatggtttcagcccctgcagattatatagtggctgaaaagcactcaatagtaggaagtattggggttaggatggatttaatgcactattatggattgatgaaaaagcttggtataaatgtaactacaataaaagctggaaagtataaggatattggttctccatttagaccaatgactaaagaagaaaaggaatacctacaaaaaatgataaatgaaacatacatggattttgttaaatgggtagcagagcataggcatttgtcaataaactacactttaaaaatagcagatggaaagatatatagtggggaggatgctaaaaaagttggattagttgatgaagtgggaactgaagaagatgctttgaaaaaattagaacagttagctaatgtctcaaatcctgagattgttgaatatggcttagaagagaataaaggattgtttggattaacatactatttaggttatggaattggaaaaggaattggagaagttttatatggaatggaaaagattaatggaagagttgagttattaagttaatttcttattaatttttaccactatataaatggctataattgttagtataataaatatgagaatatataagtaattattatacgaggatttctctttatagtggtattcttcaacacaaacggtctcttttggaatatcaattaattcaacagttgataacagtttgttgttgtcataaatttctattgtattatagtagttaaatatgtataatgtatagttatcaatttctattgaaccaggatttttttgagttacaaattccgttagtgtattatttttatagataagccagtgatcattgagtccaacccatactttaattaaaaagctgttatttttaggaatatatttaattaaagaaactaatgcaaaaccaaaatctccataaatcttatgaaggttgtcgtttattggcagagattcataacttccattatcataaaccttatataagatagcatctgatgaatacgggtgattatataaacacactccaccaactaaccaatatctctcttttggattgtaatccattgcttcaaaaatatagcatagcccatatttttcataattcgtataattaattatagtaatgaaagaaccattatatttgattaagacatttttagtgccaattaggatatactctttattggattttaaaattttacatattgtgatgtttgaaatgtttgtcaaatcatagaacttctttccatcaaattttattaacgattttgacggatagtgaagatttacttcatctaatccaattaaccaacaatctttcccataggcaatagaggaaatcaaatctgaatttgaaatattagctctcttcgtcaaatcagttatattctttccattataaagtaataaaacacctttcccaccaattaaacaatattttccattatatcctatagatgtcaagcccttgcctttgtatattatctttttatctatctttgagttgtttattgttagttttattaaagcaccaatatttggatattttggaaagtcttctatagattttaaggtaattaagtattgattatcattaatttttgcaatatcggttatataagtgcctaaataccaaacaattggtgtaaaatttgctgactctccaactttaatcctttttaattttccatttttgagggcatagtattcatagctatagctattatctcttgagaaattcacaatctcaactatccaactgttatttatccaactcactcttttaaaatgcccatcaaagttatatttataaatctttgaacgattattttcatatgacaaaatataattacacctatctttgtattttgagaattttccaactattaggtatgatgttccattaaaatcaacatcttctattatattataacaacccattttatttggaggttttggaatattgagttttggggatatgtcttctccataagtcccattaaattttattaaacagttttgtccttctagagtagtagttacaatcaaccaaaaatttccgtttggaatatattttattttaggaaaagaaaaatcatcaatttttatatttaaatatttgtttatatcttcaattgatttgttattatagattataaaaatcttggattttttatctggacagaaagcagaaactaaaaaataatctccattatcatctatatcttcaattaaaaaattaaatctcccaaaatgaataagttttttgccctctaaaagatatatatcactgctaacgttcgatatactctcattatttgttataattagccatgactccctatatttgtcccatttgattatttcaatattatttaatggcttagacggcacaattaaaatgggaatttcgttatacttaattagcttacacttatcagatattagccagtatttgccattgtaatctccaataaatcccaatgacttcaattgagaaacatccttatcataaaatatcaaatgtgcttttaaactaccacaaaataataaaaataatataaagaaaattaagattcttttcataaaattcaccaattatttattactcaactttttcaaagcatcttcagcagctaatgataatggctcatgcaccatagaaactggtggagcatagcagaactccatatttgcaagttcctctgcactaacttttttaaatattgctatagacattgcatctattctttcagcaactctctctccaccaacgatttgacatccaactactttgccatcttcattaaatatcatctttatctcaatctcttttcctcctggatagtatcttgctcttgttaacgccttagctctaccaataactattggaattctctttaaattggcagagaatgctgttaaacctgttcctccaatctctaaatctcctattttgctaacagcagagtttaaaactggatagaactttgcttcaactccagctatatttttaccagcaacttttccttgccttacagcagcagttccaaatggagatagtgttttctctccagttataaagtcaataacttcaacacaatctccaactgcatagatgtttggtatagaggtttgcatcttctcatttacttctattgcaaattttccaattttacagccagcttttttagccaactcaatatttggccttacaccagtagccataataaccatatcaacatcatacaacttaccatcaacataaactgcttcaaccttctcttttccaacaatcttttccaatggttttgatagcataaccttaattccttctttttctaaatatttttgaactatctcagccatatctgggtctaagaatcttggtaacacttgaggagccatctcaacaactaagacatctaaacctctacattttaaaccataagccatctccaagccaatagctccagctccaacaacagcaacttttttacagccattttcttcaatgtattttaatatagccctaccatcctcaatagttctaactttaaatactccatctaagtcttttccttcaattggagggataaatggctctgctccagttgctaaaactaagtaatcataattcatctcaaactcatttccatctttatctacacactttattttgttattttttgaatcaacatctataacggtagtttcagttaatatatcgatgtttctctctcttttgtaatcttctggagtgtgcataataatgtcatcaaagctctttattgctccctcaataacatagggaattgcacatggagaataagctatttccttttcttttgttattactactatttccatatctttgttgtattttctgattgttgatgctgttgttaaaccagcagctccacttcctattattattgctctcatttcctcaccatttttattggggttatttggttttctattaaccaaattattttttatcctttttgatgatcatgattttgacacaaaaatgaacttaaccaaaaagtttttatagaacttctaactaatacaataattgtgaaataaatttctaatatattactaaaaataacttaaaaatagaataagattattaaataataaaagaggggatagtatggtaaatgaagtcatagacataaatgaagcagttagagcatacatagctcaaattgaaggtttgagagctgaaattggaagattagacgcaacaatagcaacattgagacagtcattagcaacattaaagagcttaaaaacattgggagaggggaaaactgtcttagttcctgttggaagtattgctcaagtagagatgaaagttgaaaagatggataaggttgttgtttcagttggacagaatatttcagctgagttagagtatgaggaggcattgaaatacattgaagatgaaattaaaaagctattgacattcagattagtcttagagcaagcaattgccgaattgtatgcaaaaatagaggatttaattgcagaagctcaacaaacatctgaagaagaaaaagcagaagaggaagaaaatgaagaaaaagctgaataatgagtttcaagaagtaattgacttcttgaaatctcttccagaggggaggagagtatatattgagatgtctggcatctggatagaggttactaaggaagaggcaataaattacttaaaaagtaaaattaacgaaaaagaagcttaattaacttaattatattatattatttttttattttttattatttattttaattcatctatactcttacaaacacaaaactcgcacaaggaatattcattaagctgtttattttttactgggcaataatagttattgccttttttaatgatttttacatttccaggaaatgttaaatattctggatgcaatggctttttagcaataaatgccaagtatgggcagagaatttttgaaaggtttataaatctctcttcatctggtgtataatatttcctaaacctttcaattctattgagcatctcatttaatttttcttcatcaatttcttcatcttgaatctcatcaacgcttttttttctaatctcgttaaatgtttcaattaaatacttcatcatcgcctcaacataatggtttttgtattgtggagggagatatttagcatctttttcaataaaacttctaatcatcattatatcgtatatgctaaaattattaagctctttttttaatttttcaaataattcccttgctttcataatctcacaattagaatgctttctctatcataaagcataaaattgccacagctaaagctccagcaaccatctttattcctgaaattattacattttccttagaaatctttcctataaacactcccaatatgaataatatcgctatagttatacctatggcaacatataaagctgtttttatatcaaataaaaagaaaggcactactggaagagctgaaccaatagttgttgatattccatcaataagcccacaaatcatcgtctctctaatagcctttttgtaaattattgacttctttaaataaccgttcttctttaacaagctcttttctttttgtatcctctccctctccaatgatgctttctctgcagtgaaagctccaagaatattagataaaccgttagctatccctcctccaagcccagcagctataattactgatgcatctgctgagccactcgctccaataacaactccaagagctgataaagaaccatcgatgagacctctaactatgtatctcgtcccagattctccatttattgtgtttataatagatttcagactacgtggaattctcaacacttatcaccctaatttttatttattctaatttattctaaatttaaaacatctcttaaatcctgccctcttagaattctttccctaatttttctttctttctcttttatatttttagcattttcaataatctctggaagagattctttttttataactaccactccattgcagtctcccacaataatatctcctggttcaactatcacaccacaacaattcactgctacatttatctctccaagatttaaaggtttccctgcattagggcagaaattttttgcaaaaactgggaactttaaagcttttatatcttcaacatccctaacacatccatctataacaactcctctaactcccttaattttggcatttagagaggctaagcctccccatactgctgtctcatattttccttcgccaacaacctcagcaacgataaatttatttttggcaaagcttattgtcttaattaaagttccccaatcgttatagcttatctttacagttatagcctcaccaaaaacaagcttttgattctctaaaattggtttaatgccatttaaaggcttagctccagcatcacataaattgggaactgaaaaattttttaagatattcatagccctccctacaataatttttaataggactttcacagtttgtaggttttaataaggtacttagatgcctaaaggcatcaatttcctttataaattttattcctgtgaaagtcctatttcagcaacctccttagcccaatatgttataataaaatcagctccagccctttttatacttaacagtatttcataaattactttttctctatctaaccatccatttcttgctgctgcttcaaccattgcatactctccgctaacgcagtatccaccaataggcacatcaaacctgtccttagccatccttattatatccaaataaggcaaagctggcttaaccaaaattaaatcagcaccctcctctatatccaatgcaatttcttttaaagcctctcttgcgtttcctatgtccatctgataactcttcctatctccaaatttaggggcactttcagccgcttctctaaacgggccgtaaaatgatgaggcatatttagctgagtaactcattatagcaacatcatcatatccattttcttctaaaatctcccttatagccctaactcttccatccatcatgtctgaaggagcgacaatatcaacaccagcatctgcataggataaagctatctttgccaatattgggagtgtggcatcgttcaaaatctttccatctttaactattccacagtgtccatggcttgtgtattcgcataaacaacaatcggcaataactaaaagctcatcccctaactcttctttaattccccttatagttctttgaacaactccatttttatcgtaggcagagcttgctatctcatccttatgctttggaataccaaataatattacagctggaatgcctaaatcagctatttcttttgcttcttctatagccccttccacactaaacctatactgattaggcattgagctaatctccttcttctcattcccttttaaattttcatctacaaaaattggcataattaagtcattttttgttaatatagtttctctaactaaatctctaattttttggttttttcttaatcttcttggccttatcagcataaaatcacccaaatttattttaaacaacttttataaagtattttaaatcattatctccattttgataaatttttgggtggataattttcacatattcctccataacttcagagcactttagtgtttcaaattttaggtaatctttggttgttatataaaatctcttatttttatacgctctaaactttaaaaaatgaggattgttttttaacaattcttttatgtcaatatcctctcccattgtgtctaatatacacacatcagcatattttgctctgctgttaaatatttttctatcaatatagtgatagttagtcccttcaacattttcaaataggtaattgccttttatttccctaatccaattgggaatatagtgggattttccatagatgtatggttggtttttatgatagccaaaaaatgccacaactggtttatattttatgcttctactatttaaagattttaaaatccttcttttttcttcaattatcttgttaaataccttctcagcttttttatatttattgtaaaatgaggcgtaaaactttatccactccatttttcccaaaaactttggttctttgtagtttccagtttttgtgtagggaatgttatttttatccaaccacttagataatggattgaatatattccaatcaattaaaaatatcatgtccggatttatatttaagatttctccatagtttatttttccatctgttccaacatttgatattttcccctttaaataatcactgtatagaggataatatttttttaacacaaaatcagcccaaaaaactcctttaatgcttttaatcatctttttaatctttaagagatatgcagtgtctataaacatagaatctgaaacaataacattttttaatggtttttgaaagtttatgtatttattttcagcatcaattattgaattatttagaatattgaagtgtaaggcatactttatttgccgactatagtatttgtaaaaatttaatgccatagttatcacatcagttattaaaattaacttaataattatttaagatttctttatatttattctttctgcaaaaaccttaaaaactttaaaatgataattaggaaatatctaagaaaagtttctacaaatgacgataatctattaaaacttctaaaaacataaaaatcttagagggatgattatgtttttgacgttggatgactttaattttgaagataagagggtagttttgagagtagatataaactgtccaatagacccaaacactggagagattttagatgataagaggattagagaaataaaaagcacaattacagagcttataaacaaaggtgctaaggttgttatcttagctcaccaaagtaggccagggaagaaagattttactacattaaaaaaccatgcaaaggttttatcagatgttattggtaaagaagtagagtatattgatgaagttataggctctacagcaagagaggcaataatcaatatgaaatgtggagatgtcattttattggagaatgttaggttttattctgaggaggttttaagtgattggaaaaaatgggaaaatataactccaaaaaaacaggcagagacaaatttaattaaaagattagccccattatttgactattttgttaatgatgcctttgcagctgcacacagggctcagccatcattagttggtttctcttactatatgccaatgattgctggaagattgatggagagagaggttggggttttatcaaaggttttagaaaatccagaaaagccctgtgtttatgttttgggaggagctaaggcagatgattcaataagagttatgaaaaacgtcttagaaaatggaactgctgataaggttttaacttcaggaattgttgctaacatcttccttgtagctatgggatatgatttaggcgtaaatatggatattattgaaaatcttggattaaaaagccaaatagagattgctaaagagttgttaaataaatttgaagataaaatcgttgtccctgttgatgtagccctaaatattaatgaagagagggttgaagctgatttaaataaggatgaaaaagtagaacatttaattaatgatattggggagaaaactatcgaactttacagtgaaataattaatgaagcaaaaaccattgttgccaatggtccagcgggagtgtttgaaaaagaggcatttgcaaaaggaactgaagagctgttgaaagcgatagctaactcaaaagggttttcagttattggaggagggcatttatctgcagctgctgaattatttggaattgctgataagattgaccatgttagtacgggaggtggagcaaccttagatttcttagctggagaaaaattgccagtaatagagatgcttaaggaatcatataagaaatataagggacaataaatagtaaattaatttaatttttaattttaatattctactagttttttctattgttgagtttaaattggaaatatgtgaaataagaacaaatcgaaagttttaaaagaaatggtattaaaaattaaaaagacgatattaccaaaaagaaaggggattctatgaatttaaaaaaagtggttaatgaaataagaaactttgagggcattttaaggaagatagctattaaagatgttgttgaaacgtttgattttaatgatgaggattatgaatttgatattatagtagattttggtgatgatgctgctgttatagggatagatggagataatgctattttattagccgctgatggaatttggggaaagcttttagaggcagacccatggtgggcaggttattgctctgtcttagttaattgtaaagacatagcggcaatgggaggaaaatgtgtagggatgactaatataataagtataaaagataaagatatttgcagagaggttttaaaaggagttaaagatggtgtgaaaaaatttggagtgccaatggttggagggcatacacatccagatgctatgtgcaatgttttagatgtttctataactggcattgctaaaaaggattgtatattgagaagtgataatgcaaaaattggagataagattatctttgcctatgatttagttgggcagatttataaatcatttccattaaattgggatacaacaacaatgaaatcaaagaaattagttagagcccagatggatgctttagttcaaattgcagagaataaattggctaactcatgcaaagatatcagtaatccaggggctattggaactttggggatgttattagaggtttcaaggaaaggaggagttgttgatataacaaaaattccaaaaccagaagagattgatttaatccactggcttaaagtttatccgggtagtggatatgttttaactgcaaaagaagagaactttaaagagattaaagatatttttgaagatgttgagatgactgcagagatatgtggtgaggttatagctgaaaagaaattgtatattacggatggtgaaaataaagaagttgtttttgattttgagaaagagtttatttgtggttgttaatttttaatataatttttaatggtgaaactatgaaattagctgtagatgctgttttttatgtaagagaaggatttaactttgaaaaagcatttaaagaagttttaaaaattttaggagaggatgttaaaatcttatctgttgaatatccagagctggctttaatttcagagaacggctattattacagatgcggatttatgcttgataaagagttaagagaagaattaagtggagaggagattaataaaatcaaagaaaaaattaaaaagctgtttgaggatgagataatatatacactgacatgtgagatactatgaaggaggttaaagatttttatgataagtgggagccagaagatttcccaaactatataaaacttcttatgaattttgctgatgagctgatttttgaagaaatctctttattgttaaaaaaatttgaaaataaaaaggattttttggttttagattgtgggtgtggctttggagctttttataatttaacaaaagacttcaacactatatatttggatatatcattaaatttgctcaaaagatttaaactcaaagagagaaagatttgtgctaatatcttacatttgccttttaaagataacacgtttgatttagttttatgtataaatgttttagagcatgtaaattatttaaaagctttaaatgaaataaggaggattttaaaaaataaaggaaaattaatagttgttgttgtaaataaagatagtttaattaaagaagaaatttttaatgatttcaaaatcttccataaaccattatctattaaagattttgaaatagatggttttaaaattgtttattcaaactcagtatatttcctaccttcaatttttaagatatctccaccaataattttatcaaaaatcatagaatattggaagccagtggataaaaaactctcaaaaatttttaaaaataaagggcagtttttaattattgagatggtgaaagaatgaataaagcagttatttatacattaccaaaaggaacgtatagtgaaaaagctacaaagaaatttttagactacattgatggagattataaaatagattattgcaattccatatatgatgtgtttgaaagagtagataacaatggcttaggagttgttccaatagaaaactctattgaaggttctgtatctttaactcaagatttattattgcaatttaaagatattaaaatattaggagagttagctttggatatacaccacaatttaattggttatgataaaaataagataaagacagttatttctcatccgcaggcattagctcaatgtagaaattatataaaaaagcacggttgggatgttaaagcagtggaaagcacagctaaggctgtgaaaattgttgctgaaagtaaagatgaaactttaggagctattggctcaaaggaatctgcagaacattataatttaaaaatattggatgaaaatattgaagattataaaaataataagacaaggtttattttaattggtaaaaaagttaaatttaaatatcatccaaaaaattataaagtttcaattgtttttgagttaaaagaagataaacctggagctttatatcatattttaaaggagtttgctgaaagaaatataaatttaacaaggattgagtcaagaccttcaaaaaagaggttgggaacttacatattttacattgactttgaaaataataaggaaaagttagaagaaattttaaaatctttggagaggcatacaacatttatcaatcttttaggaaaatacccagtttttgattaattatttttttgttctttgtttttatgacctgaactctttataaaatatgtcagttgatggatgaacttccatgaagttgttataaacatctatccccctaattaactgagtgaagtatggaagaatttcagcacaaggcatcatggttatagctccaacaatttttccatcttcataatagattttatttatcccaacaccactcaaaactttaaagaaattccccttccctacacagcttcttattgttttataattatttgtctgcttccctacataagatatagttaaagacagccttatagtctttggaattaattcataatttggttttattagaggcttattgtttatttcattgtagatattttgggctaccactctcccctccatccttgatattggagtatttcctccaccgttgattaaacaatctccacatgcataaactttctcttcatttaaaaccctcaagtaatcatctgtcttaaatctgccatttccaccaatggctaagatttttgtataactttcatcctttaacagattttcaagctcttctttgtcattgattattttaaagtttataactttcttcattaagtaatctctaatttcctcatccttaatctctttcaaaatcttagaccttgtgtatagaacaacattacagccaaagtcagaaaatattgaagcatattcggtagctacaactcctccaccaataattaagatattttctggcagttctcttaaatttggtatatctttgtgagttaaaacctcatatccattataattggaaggataatttcttccagttgcatagatgatgtaatcataatcgttcttatgcttattcttaaactctttgtattttatatttactccaagttcttttgtttctttttctaatttattcctaattctatcctgaattttatttattttttcctgcaactctttaaatgaaattatttcctctaaatgaaccttctctccttttaaaatacttaaattattaataatatctgccatttctcttaatccagttatatatgtgcatccatagtttaaacaagttcctccaactctatctttttcaaataaatcaacatcaaagccattttttgccaaaaacatagccgatgttcttcctgcaggacctgctccaacaacagctatctttaatgtcatactttcaccaaataacaaaattaaaaattggtttaatgttattgaatataaagttaatggttaataacaattacaattaaattttttaatcaaataaaaaataagaacaacaacaataacaattgaaataaaaccatgcaaaaacttatctaaaactttcgataccattgcaataagctatttttctgcaaaaatgagaataactttctcttaaaaagaaaataaaaagaaaatagatattatttaaaaaattttaattagattttaagttcatcttcaggaccttctactgttacaattaaatactgtccatccaattttatatctgcagtaattccttttttctccatttcttctttatctctatcttttttctttaataactcttcatatttttcttttgcagtctcttcatccttgtatttttcaactctaacaactttaactctgtcgttattttcaaatgatattgacattccttctgccactgttttataccatgggctgtaagtgccactaacttcataaacacaagcatctgatggaagtctatcatatatttccataacttctctatttttcaataaagaatccatctctccattaattacatttatgcagtcataaactccctgcttagtccctgcaattatcatatccttataaaatgttaatgcaattttatcatcgttaggttttgtatatatcttaaatcctccatactcttctactggatttaccccaatttctttgagatgatttttaaacttatcaaagtcataatctccttcaataataataacgaacctatcataaccactgcctgaaaaaatcatccttttagttttgttgatatatatccctgtcttttcaccgtttgcatttcccaatcttaaagcattcaaaatttttgaacggtactctgatgaatatttgctatcttcaatatttttaaaattcacatatacaaagccattataatcaactggtaacattttgattaattcatccgcctcacttttactgtcatttaaacatccacacaatgaagttcctataattagggctaataaaatagccaatattcttactattctcataaatttcacctccccctaacaggttatcattagttataacccactgcttttttctatctcttcatattatcacctccatttgtgaagccccacaaatttgcgattctaatatataaacttttcgtctataaatttatttaactatataaatacaataatataaataaaaaagagtgcgcaattgataaaaattagataaaataaattagaataaaaaaagtagaaagtttaataataataccatattgttttatactcctcaatgttttctccaatctcttttaaactgtctaagtattccttaattggaacatcttcatatgtgtagagtttagttggatatatccccttctcccatggatgcattaaataaaccctacttccatttggctttatagctattaactctctatcctgccatgctctcaagtgatttttccccattcttgggacgttgaatattggctcatctgttctaaatgaacctggaagcaatcttgcttcctctttaacttcctgagctaatcttgctattggaaccaagtaatctttatgttccatcttcccttttggataaaaagtatagtaaggaataattccaaccttctttaaagcaattcttaaagctacgttttcaaatctcctacttacatatctgtggaatacatgttgattatagatgtagatattatttgttctcaactttttaacagcctcagcaacttctggagttatctcataacaactctctacatgtgttgaaatcatcaaactcttttcaaaacttcctaataactcagctaattcatccgttattctcattggggcagttactattgttcttgttccaaatctaactcctacaacgtggttcatctcagctattctatttagcattttttcgatagctttatcgcttaagctgaatgggtctcctcctgtaattaagatttcaatcattgaatcgtgttcagcaaaccaatctaaagctttctcaaccttctcccatcctgggaacgccttagcatcaaaatcttgcaccatccagtttctttgacaatagacacaaatctgtgggcaggattcataaggcttaatgattgctatagttacatatctccttgttactaaatctattggagaagtgtcatgctctcccatgaagtcaaatgctatgttcctatcttctttatgctcaatcatcttttcaacataccactctggtggaataacctgccttctaactgccaaatcctcaacgtaagggttttcaaagtcaaataagtggagataataaggggttaatccaaatggtatgccattctttacagctttttcaataatctctaaatcttcatctgatattttaaagtttgtcacctctcttaactctctcaatatcttaacgccttttaaacctctcaatacattcttaaattgccatttgtaattaaaccactcttcgtcagttattccaaaaaattcctctaaaatctctctattcttttttctctttaagataattctcttatctaacccacttggatatctgcttatatactccctcataatttcataaaccttgtctaagaaattagacctcgctatccctgcctctctaccttttattttgctgaaatcaataaatttaactccttcttctaataatctcttccctaaaaaccctaatgaataatctgcctttccagacattgctaagaataaatgtctaaattcttcaataaacccctccctaatttcttttaaagcctcttcatctcccttatatgctttccataaatattctaatgtgctgaaacctgccaatctctcattatctttggatattatgtttaaaaatacttcaattgcctttaaagccaaccatctatcaacttcattatcaaactttattcttcccattctaatttcccactctaattctttacaaaattcaaataatttctctctcgcttcttctacactctcactctcttccaaaatttctccaatctctggaagtggagaaaatatgtccaaaaatgttttataactaatggtttcatactcagtcatggattttattgtcataatatcacctctacaccatttaatttaaataatttgatattctattaacgacctccaaacatcttcataaactttttttgttagaatttcatcgaaaattacatcaaatctttaaataaaaataggaaaaattcctttagctaaaaacttagagcttttaaaaattagcattttctcatatcaataatgttgataatcatataaaaatttttttattatttgagattgttaataagaccatttcttatttttatgttgtattagataaagattttatgagaaatatacgattaagaaaagaaaacaaaatatttcaaaagtaaaagctaaatatttattataaagaataaatatttttattcaagataaatagctggtttaaatggaatggctactctctttttattagccttatcttctccattaattataatatcctcaacaccaacctctttctttaagaactctttggcattttctaaaacctcaacctcattaataatctctgcattaagttttattaattgattaactaactttggaatttccttaccatactttctaaattctggatttttcataatgattggcattaattctttaatagtcttcccttcattttctttaataatcttcaatatctcgtatttccaatcatctgcagtatataagtagattctctttggctgaaccttagcaacgtttataatctctttgatatcctccataactgcttttaaatactcctctcccttctcaatctcatcatttataaactcctctttaacctctgggaattttgctaatgaaacaaagccctcttttcctaaaatctcccacatctcttcacataaatgtggtgtaaatggcatcatcagctttattataacctctaaaaactcctctaaaactcttatattatttcctcctcttcttctataccattttaagtcatccaacaactgatagagcaaaattccagcttttcttagctcaaagttttccatatattcatcatactgtttaacggctttatacaatctactcaataaccatttatcaatatagctgaattcttctcctgtttctcctcttctctcagcaatctcttttgcaaataaatacaacctctctaaaacttttttggtattttccatttctttaaacttgatatcggcatcttgtggtagttcagcacaggttgttatatagaatctaccaacgtcagctccaaatttctcagcaacttctaaaactggcaatacaggaccttttgacttagataactttttcccttcaattgtaacataaccattaactactatccctcttggccaaaactcttctgggaatattgcaacgtggttaaagatatagaatgttaaatggtttggaatcaaatccttagctgaacatctccaatcaactggatagtagtagataaattcttttctcataccttcaataatatcctttggaattcctgtctctttagcaattttatcaacatccccttttcctaagaacacataatcaaataactctaaagtcaattgctctggctttatattatgctgattgatatattttgctactgtgtagtatgctggataaattgttgaatcagatagagattcaataacccatccctcttcaaatgggaactttgttcctaaacctcttcttctaacacatgccttgtccttcatccaatcaatcttctcatggaatacctgccttaaattctctgggatgaatctcatcttatctatacatttgtgagctaattctttccacttctcatctgaatatttgatgaaccattgtcctttaaccatcttaactatacatggggttccacatctacagataaccttttcttcactaaattcatacataatttctgccaaacctttatcaattaaatcctttgttaatttgtctttaatctctctaactggaattccttcataatctaagcagttttcatttaaaactcccttgtggaattcatctttatagatttttttagttgcttcctctaacttatcctcttcttcctgacttttaatacccatcttttcaacaatttcctttgcaggatattttccataaccagggacgttaattaatggaattaaaccaatttcatcaactaatcctaaatcccttaacgctatgtagtcgtaaggtgcatgtgctggaactgacatgacacatccagttccaatatttgtttttacaaacttagctggcaatattggaacttcttttcctgtcaccgggttttttacttttttatttataagctgttctcctttaaattcttcaataatctctatctttctatcttggtgttttaatttttcagcacactcctttgccattatccatatgccattctcaattaawtcaatcccattttcagtttctttctctaaatagacctttgcctttacataagttgcttcaggattaacccaaacgtttgtaactccaaagacagtttctggccttaaagtagccattggcattatacagccatcttctgttgtgaattttattaagatgtattcaactaaagttgcgttttctccaactaatatgtcgtggtcttctacagggttgtcgcatcttggacagtatctaactgggtgagaacctttaacaattaaccctttctcttttaatttgtggaactgccattctataaatttgttaaaaactttatcatccgttttaaagttccttctccaatctaagctaaatcccattcttttaaatgcttcttcagctttctttgagaaatattcaacaattttctctggtgttgttagttctaataactcttcttttggtattccatgtaattcagtatatgcccaaattgtcttttcatctctattttttattaattcagctaaacctaagattggtgttcctgtaacatgataaccaaaagtccataaaacgtttttatttttcattctttggaatcttgcaacaacctctgggatagtgaaagttcttaaatgtccagcatgcaaaactccatttaaatatggaaatgccgcagttataaaaaatttctctctatcatctggatttgcttcaaatatctttgcctcttcccatcttttttgccacttcttttcaatctctttaaagtcaatcataaccatcacatcctttcatttttaatgttcaatacttagtttttacaaaacattacattattaaaataattaaggtatattaataaggcgtttaaaactccatttattaatttaacccttttgcaaaggactataactacaaagttctacaatattctttttatagcgttccacactaaaaaactctgcggttttaaagttccttcgattggatttaagaataagatgtttttcttaactaaaaattctctaagttttttaggtatttttatatcttcaatttcgtaactatctttaaatatttttaatgcatcaacaacttttttataaagttcttcatcttcttctttaacattctctaagaagtattttagtttttgggtttcttctttaagcattgaggttaagatatcttctaatttcttatatttcatctcattaataacgtagattatatctattggttttccccctacataattatagattaactctttatcttcattagttaggttaatattattctcctttgctaaaaaatccataaactttaaagcagtttccctatcaaaatcatcaactaaaatatatttgcatcttccttctaacattgcctcattataaaccctctcaataaataagctatcggagcttaaacaaaaaacatgacatagatgcttatgcttagttagagagacaaagtaattaaaaagctcataaattaaaaatccatttagttttaagtcccctattttttgtagttcatctataataattattggttgttttccttctcttttaatcttgattaatacagaagttatatatctaaagacatttttaacattcctcttttttaacaattcatttagggtattttttggtattggaatgctatcaacaactcctgtaatgtttaacaaagcataactcttaataacatctggataatctttaattagggataaaaataacctcttaactttatcaataaatggttcttcatactcctcaaacaaaacttcaatgaagtcatcatacttagatataaatatttccctcaaatcaaaataaaacacaacatacttatccttatttaatctattattaataatctcatttattaaagcagtttttccagaatttatagagccaaagataaaatttattctttgaggttctgactcaataatatgcaggatttcctctatttctttctctctgttgaagaatttcattttaaaccccctaatcttatttagctaattttagctcttctataatctcaataagtgtatttactaatttatccccagataatttaacctcttcagatatagggcaaaaatctataatttttggctgaattcctaaaataattatttctgcatttataaatttttttaaatatttaactattatagacaatggcaatgtatgagttgagaaactgtaatttattatttcatcctcttttataatcttaacctctccaacatctttatccattagggcacagtcgattattaaaatatgagttggttttatctcttttaaaatatctgtaaaaaaatcaggaacagttccagcatttattaaatagagatttttgatgtttataaattctttttcttctccaaaatacctcatcaattttttaactacataaatgccaacagcatcatctcctttcaactcattcccaatgcccataataaccaattttttgcagttctttagtttatccaataacatttccttcattatatcatcctatttattataaaaccaattattaaagctattattggagctacaacccaccaaaaaataatattttttaaaactttccatcttactgtttttattcccttagttaaaccaacccctaagattccaccaacaattgcttgagtcgttgaaactggcatacctaaagcagtaaaaattgttactgccaaacctccagagagttgggcaataaatgcagagctaacactcaaatttgttatcatagataatgtttctgaaaccctatttccgtataaataagctcccaagcataaaaaaatagctccgataatataaattatttgggatgttgtaaatgttcctaatacagttggtaaatcgttacttcctaagttgaacgctacaacagcagcacttattaatagaaaatatctaatcattgttatctttttgagaattgagatatctatcttttcataagctgaatacaatatataggcaataacaacagctataattggagataatatccagcttaataatatctcaccaaatacatatagatttgatgagttaaaatttaatccaattagagagcatataataactgtatgcaatgatattggcacttttttgtatgttgagagtgtcataactaaggcagagattattaaagcagttaaagcatcagaagataagctattaactgtacttccaacattttttgcaaataaagaaccaattataactgaaatgctaaataaaattagcagatttctatatgttgttgctcttgatgcataggcagtgcctatagcgttggcaacattattagcccctaatataaacaataaataaaaacttatgattagctctaaatttatagaaatctctatagtaatcacccatttatctaaaactcattttattttgtgtgtaaataaattatatgtaactcatcagccacatcttctatgtagtcgctaatattaacaatattatctataaaatcacacaaaatttttccctcccaaaatgattcaacttccaaatttattaaatacttataaatcctattttgataaacatcatcaataaatttttctttgtctttaatctctttgataattgggtctaaatccccacctttttcaataacatctaaaactctatctaagtgttgaaacatatccacggtaatcattaaaacaaggtctatttcattttttaaatactcatcaaactcttcctttaataactcatataacatagcggcatgttttaagctgtctaatgtctcatctaaaagctctgcagaccttgataactctcttctcatatttggtaaaaatgccttttctaagtttatccttatattttttgtagtttcatctccttcctcttctatttttataatctcttttaatattttttcatctttggaattcatataatcttttaatagctcaatgcttttaagagacatctgaattaataatctaagattatctattacacttttctcattatccctctcaaataaaaaaatagacatagtaatcacatccattttagatttttcttagtattttatctattttacttctatcttttaaaatattttcaacatctgattttgaatttacaataattttgtatttatttttagataattcaacgtaataatcatcattaaaatcaaccatttctttaatggatttaactcttgctggactttctaattcataatctgatgcatttcttaaatctctcaaaatagataaggcattataaactcttctaaattttccatcttcttttttaagcacattaagaaaatctaaaataattttatgagaattagacagttcaattaaatataaaaattcttttgcctcttttgagttgtaattttttaaattttcttttaaaatccctcttaaaaatagaaatgacgcataatagtatctcccaataattgttcgattttttgcctcttttttatctacttttgattcttctaagaattcagcaatatatacaaaatctaagggattaaacatctgtcccacctgtaatgggataaactaaaacatttttagattttggattttcgtatattttgttttcaatctgttctgaaattttaaagatattttctttgtttttaaattttataacaactattaaatgcggttctggatgattttcagaatctatgagcagttttatttcttttatatgattatcatagattttcaaaaatctttcaagaattttcataagatattgaataatttcaaacttattgtccaagctctcttcaaatattgatttatcaaaatatattttctcattacctcttatagtattgataattaaatctgggcttttaacatcaatttccataatttcaccaaaaagtattataaaaaattattatttgcccttagtagctatttttatcccatctttatcaataacagcaacagcacatgcaacaggatgctcaaattcctcataatttaatatataatctgctatctcttcagctgtctctcctttaatatctataatctggttttcatctattttacaggcgttataaactcccaaataatagcctttcccatcttttagttcaactttcttaactctaatgtcatcatgagcaacataacccatatagcattcgttttcatctaaaatagccgcaatccttggggtcttataatcatctttttcatagtccataactgccaatacgtaagctaacgcatctctctttccaaagtgcaatttttcagctataaagtcagtatgtgttccgttagaaacaacaatcgttttatcaataacctttatgcaattgtatgtgatatatgggtttttaaacatctcattcaaatcctttggaattattgcaactgtattgtcatccattttctttgcctctctgtttggaaagcttctacttgagactctataggcagcgaatggttttccttctttagtttttccaacaactaagaatcttccaatatacataaattcacctctccctaccataatagcatttatattgttttgagtattttaaaaccttaatggtttcattacataataaaaaatcttttaggtttagccttaaaatcttaactttatttcaaaatctctcttatagcataccatttctttacagaggttggcttaataattccattaataacatcataaaataaaatctcatttttaattaaaaacttaaaatacttcatctcctcttttttaacttctttttcataagagatttttattttgtccttaaatttagataaaactttataaagctcctcttcatccaaatcagttgtatctattaaatactttattttatccttctcaatattaatccattgccttattgtctcttcaacagacaaacctaattttttattctcaatcaaatcaactatttcataaggtagagataaataatctaaacaataattaatctcttcttcactaaacccctcctctttcaaaatatttcttatagttccttttcttaaccaatcaattaaataatactttgaagtattctctaaagttgaactttgataaatctcctctataaacaatgtatcagaggttaaacaaataacatggcataaatgctccattttagttagagagacgaagagattaaacaattcatttaacaatgacttaccaccgttaaaataaatatttttcaacttctgcaactcatcaattatcaaaactggtttctttccatcttctacaacagcatttatactctcatttatctttgcaaagacatcatttagttttaagttattaaaatcaaagttctcctcaacaccaaacttaaaaactcccaagttaagttctaacttatttagcagatattttttttctgacttctcaaaaaatactcttaaaaattcttctttgctataggttgcatacttccttagattataatagaaaaacactatattactatcttctaactctttaataactcttctcattacagttgatttaccagatgatttagggccataaacaaataaaatagagtttggatctaattgacaataggtttttaaataattcagctctttctctctattatagaatttcataatatcaccaaaaaagatatataatgtttgtttaaaatctgtttagctcttataatgaggtatctacttttatggcatttataggacaataccttgcacaaatcccacaatttgagcatttattttcatcaactatagcaactccataggtttttattgctcttcttgggcaaaatacaacacagttcccacaaccaacacatttctctaatatctttatccccattgtagcaccaaatattattcttctattgggattaatttagcctccaacttatcctcaacacttaacttcataatagattttagaggacatcttgggactgttggagaaccaggatttaataataaaatatctctacaatcatctataaatggtgtgtgggtgtgtccagatattaaaacatcaactcccatctctttacctaacaacctcaattttaatctatccccccttggataaactacatctccatgaataactcctatcttaatatcatttatctctaaaatctcttttcttggtaaatttaaataatccatatttcctttaacagcaacaaccttagctaaatcttttaatgagtctaaaatttctttatcagttacatctccacagtgaataattaaatccacatttgaaaactcatcaaaaacagcttttggtaattcaaaagctctatcatagagatgggtgtcagagataaccccaataagcatagtcccacctaaaataaaaaaagtggtgtgcatggcttccttggggtgggcatgtcctccagtcctccctcgcccccagattccttctccgtcccgcacccccgtgagcgccgacgtcctgcctaccgttgctcccttccgggcctggcggggttcggcaggtaaagggggttacatctcccctacaggagatgctcccccaccgccgagccccacgggacgagacctcatcgaggagtctgggaaggaaggactggaggacatgccgcccccaagttttcggcccccgcataagggcgatttcgggttacaggggacgcccaaccccccggcctagccatgcacaccaattaataatataataggactttttatatatagtttgtggtggtgcgtagaagtttatcacattaatttttaagttaaagtatatataattgaaaaatataaagtaaattttgtatagttttttacaactaactaaatgggtattgatttaaccttaacttattggtttgcaaggttattatgtgtaatttatgagaaatgggaaatgatttataaattcaacattaggaatttaaggatgataattatgaaactcgtaaaagatgccttatcaagaagtgatacaaccagatatttaaaagatgagtttggagaagcaagaatcgtagtagttggttgtggtggagctggaaataacacaattaataggttaatggagataggtattcaaggagcagaaacgattgcaattaacactgataaacagcacttagaagttatacaggcagataagaaaattttaattggagctacattaacaagaggtttaggagctggtggttatccagaaattggtaggaaagccgctgaaatggctaaaaatatattggaagagcagttaaaaggagctgatttagtttttgttacagcaggaatgggtggtggaactgggacaggttcagctcctgttgtggctgaggtggctaaagaaaatggtgctatagtagttggagttgtaacatatccatttaaaattgagagggcaagaatgaaaaaagcagatgaaggaattgcaagaatgtcagaggtttgtgacactgtaattattatagataacaataaactcttagacttagttccaaatttacctataaatgatgcatttaaagtagctgatgaaattatagctcaagccgttaagggaataactgaaactattgctgttccaagtttaataaacattgattttgcagatgttaaggcagtgatgagtggtggaggcgtagcgatgattggtgttggggaagttgatagcagtgacagaggagatagagtgcaaaatgttgttagagaaactttaagctgtccattattggatgttgattatagaggagctaaaggagctttaattcatataactggtgggccagatttgacattaaaagaggcaaatgatattggagaaggaattacaaaagaacttgacccagaggcaaatgttatatggggagcaagaatagaccctgaaatggagggctgtattagagttatggcgataattaccggagttaaatctccaaacattgtagggaaagacacaaagccgaaaagaataattccaaaagtttcaaaagaacaaagtcaaagaaaagaacgtaaaataggaggtattgactttatagtataaatttaattaaattgatttggatttattttaaaattttaatttttaacttttaaattttttaataaattttttaaattttttattctttaaaggggttatttatgaaggcatgcgaaagattgttattaaagatagagtcccaagagaaatttgttgaagaatttaaaagaattttgcttgagttgggcttaactttaaaggaattttctgaaatttcagggattccatacagcacattatacaaagttattcaggggaaggattttagggtctcaactctaataaagattttaaagacgataaggtcttttgaaaaggatgagaatattgatacaatagcaattattgccgcaagacctgccctaaataaaattacgacaaggaagatagggattaatggaaaaagttatttaataaaagagtatccagccaattctttggaggagtgtattgttgcagctgttagagctgaaagagaaggggttaagggcatagtttgtgctcctattgttagtgcaactattgaaaaaatcgttaatgtccctgtagctgttattattccagaaaaggatgcgtttatgaaagcattagaaataattgcaaagaaaataaatgaataatatattaagatttaacatattgaattattttttctaagagtttatcggctatattaacctcagagaccttagataatccaatccaagatggtgttgaatttacttctaaaacttttaaaccatcttctgactcaattaaatcaactccagcataaaataaaccaagagcattttttgcttttaaagccaatttttcaatttcttcagttatttcacatttctcaactcttcctccctgagaaacattgtttttccaattttctcctccaatcctatacattgccgcaacgacctcatcatcaactacaaaagcccttatatctctatgttcatttcttactggttttataaattcctggatatagaaggtattatatttttctttaaattcatttaaaatctttaacttagtagatattggcagttcttttttaaccctaacaattccctccccaccacatccaaatattggttttaaaactgcttcttcaaatttatctatccagacaattgcttcatttatactttcagtaacaacagtctttggttgtgggagattatttaattcaagaaatacagaggttaaaaacttatttgatgccctatctattccatctggaggatttataacgggaatataatgatttaaatactttaagacatcaaatctaaaaaaactatcccagccaagatttctaacaaaacagcaatctaattcatctaaaaatgacttgtaatattttaatttaaaatccaaattaaatccagctacaatatttgaaggggttataactttataatctacttcatacttttcacaggattttattaaatcattgactacagcatctctttctatggtaattataccaagtttcattactatccccttatataactaaacagttaaatattaatgaagtatataacaattaattataagtatgttatgtagttttatctttattgcatagagtaaaattaatgtctttcgaaaaataataaaacaaaaataataaaatttaccaatgaagtttgaacgccttcctttggaaggcgttcatgagtgccttagttattctaaaaagttttaaaagacactatataatttttgacatgagagatgtttttattaaataatattatattcatgcatatattttaaatatatcaaattattatggtgatggaatggagaaaaaaacgttatcactctgtcctatatgtttaaaaagaatccctgcgacaattttagaggaagacgggaaaattattattaaaaaaacctgcccagaacacggagaatttaaagatatctattggggggatgctgagttatacaaaaaatttgataaatatgagtttattggaaaaattgaagtaacaaatacaaaggtaaagaatggctgcccttatgattgtggtctttgccccaatcacaaatctacaactatactggccaatatagatgtaacaaatagatgtaatttaaactgccctatatgttttgccaatgccaacaaatctggaaaggtttatgagccatcttttgaagatataaagaggatgatggaaaacttaagaaaagagattccaccaacaccagctattcaatttgcagggggagagccaactgttagaagtgatttacccgaattaataaaattagccagagatatgggatttctgcatgttcaacttgcaactaatggtataaaattaaagaacataaattatcttaaaaagctaaaagaagcaggattatcaacaatctatttacagtttgatggaatctctgaaaaaccatatttagttgcaagaggtaaaaacctccttcctataaaacagaaagttattgaaaattgtaaaaaagtaggatttgatagtgttgttttggttcctaccttggttaggggtgttaatgataatgaagttgggggtattataaggtatgctgctgagaatgtggatgttgttaggggaattaacttccaaccagtttcattcactggaagggttgatgaaaaaacacttttagagggaaggataacaattcctgactttataaagttagttgaggaacaaacagatggagaaataacagaggaagatttctatccagttccttcagtagctccaatctctgtgttagttgaaaaattgacaaatgatagaaaaccaactttaagttcccatcaacactgtggaacttcaacatacgtatttgttgatgaagatggaaaactaattccaattacaagatttatagatgttgaaggatttttagaaattgttaaagagaaaatagaggaaattggaaaatcaaaaatgcacgatgttaaagttttaggagaaattgctttaaaattgccatctttaattgatttagataaagcaccgaaatcagttaatataaaaaagataattgatttaatcttaagtgttttaaagagtgattacagtgctttagctgaacttcactaccacatgttgatgattagttgcatgcactttatggatgcatataactttgatgttaaaagggttatgagatgctgtattcactacgcaacccctgatgatagaatcatcccattctgtacatataatacattacatagacaagaggttgaggagaagttctcaataccattagaagaatggaaaagaatgcataaaataggaggagaagatgatagagaagattattaaagagagtagggaaggggttttaattgatattgatgttcaggcaaatgctaaaaagaatgaaattgttggtataaacgaatggagaaagagattatcaataaaaataaaagctcctgcaacagaagggaaggcaaacaaggagataattaaattttttaaggaaatttttaaaaaagatgttgaaatagtatctggaaagctaaatccacaaaaaactgtattgataggagatattaaaaaagatgaagttattgaaatattaaaaagatatttataatcctatcaattcattaagcttttcataaacttttttatttacctcctcatagatgctgtttccatgactatccattgccacaattaaagggccaaaattattaacttccaactcccaaacagcctctggcatccctaattcatctaaaaaatatacgttatcaactctttttactgaattagctaacaaagctgcacaacctcctggagctgctaaataaaccacaccataatcttcaaaagtttttaataactcttttttcattcctccctttccaacaattgcagagatgttagttaattttatgaactcctcttcaacatcattcatccttgcagatgttgttgggcctatagaaacacaaacccagctatcatttacttttttcattattgggccagcatggtagataatagattcattcaaatcaaaaggtagtttttcattgctttttagcatctcaataatttttaaatgtgcttcatccctcgcagtgtatattttgccatttaaatagacaatatctccaactttaagctttttaacatctttttttgttaatttgttaaatgtatattccaaaatatccctcctgatattttatagcttactctataatcaaaaccataatttatttataattagttttaaaatctcttacataaaaatttagacctttttggtgaaaagatgatatgtataatcatgggtagtgaaagcgatttaaaaatagctgaaaaagcagttaatattttaaaagaatttggtgtagagtttgaggttagagttgcctctgcccatagaacaccagagttagttgaggagattgttaaaaattcaaaggctgatgtatttatagctatagctggattagccgctcatctaccgggagttgtagcaagcttaacaacaaaaccagttattgctgttcctgttgatgcaaagttagatggtttagacgctttacttagctcagtccagatgcctcctggaattcctgttgctactgttggaattgatagaggagaaaacgctgctatattagccttagaaatcttagctttaaaagatgaaaatattgcaaaaaaattgattgaatatagagagaagatgaagaagaaagtttatgcatcagatgaaaaagttaaggaaatgtttaaataactataaccattaaatttttatgttataacgttgctaataatttttacttataaaagtggagagggatttacatgcagagagtgaatccaacaagaatggagttattaaaattaaaaaataaaattaaattggcagaaaaagggcataaattgcttaagcagaaaagagatgctttaatcatggaattcttccaaattatagagcaagcttcagatttgagggataaggttgaggcaaagttagctgaggcatataaagatttgataatggctcagacagttatgggaactttagcagttaaagaggcagcattagcagctaagaatgataaattagaagttgatatggatacaaagaatattatgggtgttactgttcctacttttgaaatatacaacgttagaagaaaggttggtgaaagaggctactcaccttacggagttagctcaaaattagatgaagcagctaagaaatttgaagaagctttagaattaataactgaattggctgaaatagagacatcaattaaactcttagctgaggagattataacaacaaaaagaagagttaatgctttagagtatgttattatcccaagattaaaatctctcaaaaagtatatatcaatgagattggatgagatggaaagagagaacttcttcaggttgaagttaattaaatcgagaattgagaagagagaagccgaaggggagacagtataattacaaaaataatttttgatgcaactgaagcgttagcttcgggttacaaattcgaaggatttgtttaacagaaagctttgctttctggctacaaaaactcgaagagtttttgtttaactttttctaaaagttgcagggaaaacttcttcagattgaagttgattaagtcaagaattgagaaaagggaggcagagggcgagacagtatagaaattaaataattataataaataattcttagttttttggtgatgtttatggtattcagaatacttggaagaatgactaaaatagaaaaagaaattaaggaagaagaggcaaagtacgatttaataattaaaaatgaagcaaaaattgaaccaattgttgctgaagaggatatggagtttaagcagggtgatataaaacctataagaattaagaaaattaaaattcctccaatgtcagttttgttaatttgtccttacggtaggcacagagttgggcatgttgtagctgtgggagaagaggttccaatgcctatagatgttgaaagagaagttgatatggcaatgtttgcatgtggatttgagggagaagtgaagaaaggagatttaatcggaatgttacttatacttgcagctgaaaaaagagagtaagtaatttactaaaaacttttttattatttctttatagaaaatttaacaaaattttattatttttgaaagatgctaattttgggattcctatggagttaattgaaatattgctaaaaaaactaaacaaaaatgcagtagttacagagatagccaaagataaagacccttttaaggttttaatatcaactataataagtgcaagaacaaaggatgaagtaactgaagaggtttctaaaaaactatttaaagagattaaggatgttgatgatttattaaacatagatgaagaaaaattagcagatttgatatacccagcaggattttataaaaataaggcaaaaaatttaaaaaaattagccaaaattttaaaagaaaattataatgggaaagttccagattctttggaagagttgttaaagctcccaggggttggaaggaaaacagctaatttggttataaccttagctttcaacaaagatgggatttgtgtagatacccatgtccataggatatgtaatagatgggaaatagttgatactgagactcctgaagagacagagtttgaattaagaaaaaagcttcctaaaaaatattggaaagtaataaataatttgttggtggtttttggaagggagatttgttcttcaaaatctaagtgtgataaatgttttaaagaaattaaagagaaatgcccttactatgaaaaaattaagcactttgaaaatatattaaaaaaattcaattttagaaaagtctcaaaaaacaaaatccctaatgaaaaaggaacttacatcttaaaaattaggttaaaagaaggtaaaaaaataaaatttggaaaaacagagagattttttaaaaaaggatattatttctacattggctctgcctttggaaattcaatgaacttaaaaaataggatagagaggcatttaaaggatgataaaaagatgcactggcatattgattatttattaaaatatggtaagattgaagagatttatattacaaatgagagagttgagtgtgaggttgcaaatgaatttataaaaaaatttgattttgttgagaactttggatgttctgattgtaaatgtaagagtcatttattttatttgaaaccatagagggggcgtagccccctctatggtgtggatacccagagcggggcttcactacgttcagccccacttaattaagaggcattgccgagtgaagcgaggtaatgcatcctgttttaatgaaatggaaagctacgctttccagctatgaaaactcttttagttttcatttaaccgaagcgttagcttcgggctatgaaaatctttgattttcatttaactttttctaaaagtttcatagcaataggaggtctcctcctatgctgtaagagtcatctcttctatttaaaaccataatttacttaaatctctcctttccaccaatatttttaattatcttcaaaaattccttttctatattttttaactcatccttattgtatccataaattctaaatgttatacttttatacccttcttctattttttctccctcataaacatcaattatctcaatatcgaacattttctttaataaatttaaaataacttcctcatcaacatcctttttaaataaaacagacacatctatatattttttttctaagtgcttcttttttagtttactcaactcatctccagcaaatacctcaacccttaaaatattaaacttctgctctttgccatttttatttaatattaagtaatcatcttcaatgtcttttaaaactccaaaatgaacaacatttgaatttatattttttacagccacatctttaccaatgagtttatttagcttttcaatttcagatgttaatgcaaacacggccttatctgaataataagcccctctctttgcctcactaccaaaatgctttgcagcttctttcattatcttaacaaaaccttctctatctttatttttaacaatttcactgatttccttacactgatttataaaggtttcatgaatctcctttatccttggattaaacatttggatgtcagcatataaatagggattctgtcctataatcctcccaatgatagaaatcatcaactcgtatattggggaggcaaactttcttgactcttttatatcaacgttgagttcttttaacgttgctcctaaagatataaaggcgaagtgagtcaaaccctgaacaatccccataattctatcatgtttttctggagggatgactataaccttagccccttctttctttaaaaaattataaaccttgttaaaccactcagtatttttatgcttttcagaaggggttaagataaccacttgtcttaacaaagaaggtgttgatgggccgaacattgggtgggttggaataactgtaactccctctttaacatgctcttccatagcttttgaaggaatctctttaattgaggttatgtccattaataaacatccttccctaacatgaggagctacctcttttataaccctttctgtaacatttattggaactgctacaataacaatatctccttttttagcagcttcaatgttgttgttagtaaattcaacccctaactctttctcaacattttttcctttctcaatatctctcccagtaactataacgttaaaccctttattttttaaatatcttgcaaaccacttccctaaaccatcagttcctccaataattgagattgttaagttcgtatttttcataatattccccctttataggattgtagtatatatattttgatgaaactttttctaaaagtttcattgttaggtttttattttccatgaatttcacctaaataagatttaataaaatataattaactgaaattcctaaaattgttccagcaataacttgagaaactgtatgtttctttaaatagattcttgcatatccagtaatgattactaatattagatatatggtggataaccaaatactgtttgtgaaagcatatatgagataagccatggcagataatccataattatgcatgcttatcttccaaaattttgtgattattaaaattactaaaacattaaccagaaaaattattataaagatatttttccaaaatattgctaatattgataaataaattaaagtaaaaattaatgggactaatctattttttctgttaggaatatcccatgtttcattttttatctttgcccaacatatccaaaaaacacatggaaagaaaaatgctaatgataaagagatatcaaattttgaaatgagtaagaatccaatgtataaaaataacaaatacatcaaagagagtatttgaaaaatctctcttatactcaagattttcaccagaacatcatatatagcatatatccaattaaagggagtccaacaattgcccaaataaatggattccattttaaaactttttctccatcaaatggaggtattggaagcatattaaagccagctaagaataggtttatatggaatccaaaaattcctatccaatataataaagaacccggtttaaagattaacattaatataaaaaacacaaatgccaaagcaacgtttgttagaggtccagctaaagctatttttccattctcttctggggttaaataatctttgtaaatataaactgccccgggagctatgaatgtagctccaaagacaagctttaatataaaacctaatattaagccttcataccatgctctaaattcactccacgctccatacttccttgctacagttctatgcattaattcatggaatataaagccactaccaacggctattaagctaataataaaaacaagaattgaaaaatttggataagagaaaataaacgctattgccaataccgatattgttaagtcaattatctctctttgtgaaaatctaaagatactcattttttcaccattggatttttaatagtatcttacatccattttcctatatagtagttttccaaatattaatccagttataagcccagctaagtgtgttatgtgtgcaattccagtttttaaagagtaagggagtagaattaaatctataagtgcaaatatgattactgccactcttatatttactgggattggtaagggaaatacaacaactcttaaatgtggagctaaaatagctaaagctcccattattccaaatattgccccagaagctccgactgatgggttgtaatccccagtgaaataggcataggcaatatatgctaaattcccaataattcctgagaataaaaagattatgagatatttttttgagccaactatattttccaagtatgttccgaatataaataatactaacatattcaccaataaatgagttatgcctgcatgcataaatatgcttgtaattacttgccaaggcatattggtaaagagatttggccataatgcaaaatagtaatatagctgtggcataaaaacactaataataaacatagctatgcaaatccccactattaaaatgttaatcattttctaccctcccccacacatttatttataattcgtttatattattgttttataacaaatatcacatttatgtgacatttttagattattttaataagttattgacctataaaaaggtgattgaatgggacttaatataactggactcatccctaaacacatggagaataggggaaaactaactttaaaagaaaacttaaaaattattgaaaatattttagagcagagaaaagctccagagaatggaatcgatgaagagcatataaagctattgttgaggctcttatcttttatggacactgacaaagacccaaatgttgtgcagattggtgagagagaggcaagggtttatacaaaacttcaaagggatggtgtttttgatttctgccatggtgttggaaggagtgggaatttaatagaccctcaaccaaaagctccaggagcaagtgtgatgtataagctaactaataaattattagagagttttttaaaagctttagggttaaaggtaaatgcgatagcaacaccagtagccactgggatgagtttagccctctgtttatcagcagcaaggaaaaaatataactcaaatgttgttatctatccctatgcagcccataaaagtcctataaaggcaacttcatttattggtatgaggatgaggttggttgagactgttttagatggagatattgttaaagttgaggtttcagatattgaagatgctataagaaaagaaattaatgagaacaacaacccagtagttttaagcactttaacttttttcccaccaagaaagagtgatgatattaaagagatagcaaagatatgccaagattatgacatccctcatataataaatggtgcttatgctatccaaaatttttactatatcgagaagctaaaaaaagctttaaagtatagaattgatgctgtagttagctcatcagataaaaatctatttacgccaattggtggaggaataatttatacaaaggatgagagttttttaaaagaaatatctcttacttatccaggaagggcatcagcaaatccaattgttaatattttaatatctctcttggcaattggaactaaagactatctaaatttaatgaaagaacaaaaagagtgtaaaaagctattgaatgagttattggaagatttagctaagaaaaaaggagagaaggttttgaatgtagagaatccaatttcttcatgtataacaacaaaaaaagacccattggatgttgctggtaagctttacaatttgagagttactgggccgagaggagttagaaggaatgacaaatttggaacttgctatttaaaagagtatccttatgactatatagttgtaaattcagctattggagttaaaaaagaggatatctacaaagttattgagaagttggatgaggttttataaaaagggataacatggagttaaaaaataaaaagcttagtttgtgggaagctgtttctatggctgttggtgtaatgattggggcaagtatattttctatatttggagttggagctaaaatagctggaagaaaccttccagaaacatttatattgtctggaatttatgcacttttagttgcttattcctatacaaaacttggagcaaagatagtttcaaatgcgggacctattgcattcatccataaagccattggagataatataataactggagctttgagcattttattatggatgagttacgttatatccattgctctatttgcaaaagggtttgctggctatttcttacctttaataaatgctccaataaatacattcaatattgccataactgaaataggcatagttgcgtttttcactgctctgaatttctttggttctaaggctgtagggagggctgaattttttattgttttggttaagctcttaatattagggttgtttatatttgctgggttgataacaattcatccatcttatgtaattccagatttagccccatctgcagtaagtgggatgatttttgcatcagctatattcttcctatcatatatgggttttggagttataactaatgcctcagaacatattgaaaaccctaaaaagaacgttccaagggctatatttataagcatattgattgtgatgtttgtgtatgttggagtagccatttcagcaataggaaatttaccaatagatgaactaattaaagccagtgaaaatgccttagcagtggcggcaaaaccattcttaggaaacttagggtttttattaatatctataggagctttattttcaatttcatcagcaatgaacgccacaatatacggaggggctaatgttgcctattcattagcaaaagacggagaacttccagaattctttgagagaaaggtatggtttaaatccacagagggactttatataacctcagcccttggagtgttgtttgcattactgtttaatatggagggggtggcatcaataacaagtgccgtatttatggttatatatctctttgttattctctcccactatatccttatcgatgaagttggagggagaaaagagattgtaatctttagctttattgttgtattaggagtttttctacttttattgtattatcagtggataaccaatagatttgtgttttatgggataatagcaacatttattggagtgctgatatttgagattatctatagaaaagtaacaaaaagaacattctccaacaatatgtatgttaaaagctaaattttaacattattaacattaaagctgtaggaggtcgtgctgtatcgtggtcatcttcattgagcaaaagccctcttcccacgacgcgcccagacctccttttttgttcccccaacttcgaacccgctatcatcgcaactctctggatatgctccatttgggtcggttcgttggggataaatatatatctctatgcggttatataaaatttagcacaaacaaataatgaaggtgagagagtgagatatgtagtagggcacaaaaatccagatactgatagtatagcatcagctattgttttagcttacttcttagattgctatccagcaagattgggagatataaacccagaaacagagtttgttttgaggaagtttggagtcatggaaccagagttgatagaatcagctaaaggtaaagagattatcttagttgaccattcagaaaagagccaaagctttgatgatttagaagaagggaagttaatagctattatagaccaccacaaggttggtttaacaacaactgagccaattttatactatgctaagccagttggttcaacagctacagttatagctgaactctactttaaagatgctatagatttaattggaggtaagaagaaagagctaaaaccagatttagctgggcttttattgagtgcaattatatcagatacagttttgtttaaatcaccaacaacaactgacttagataaagagatggctaaaaaattagctgagattgctggaataagcaatatagaagagtttggaatggagattttaaaagctaagtcagttgttggtaagttaaagccagaagaaatcataaatatggactttaagaactttgatttcaatggaaagaaggttggaattgggcaggttgaggttatagatgttagtgaagttgagagtaaaaaagaagatatttataaattgttagaggagaagttgaaaaatgagggctatgatttaatcgtctttttgataactgatattatgaaagagggtagtgaggcattggttgttggaaataaggagatgtttgagaaagcatttaatgtcaaagttgaaggaaacagtgtattcttagaaggagttatgtcaagaaagaaacaggttgttccaccattggagagagcttataatggataaatctttttaattttttgtgatactatgggagctgatatattaacttctaaagaacttcttaaagaacttggaaaagattttaaaagagatattgaagatatagatttagaattttatgagattagttataaaaagatgaaaaataaagaatgaggaaaattagggatgatttatgcactactccataataaaaccaaaatgtaaaaaagagattattgagatagataaaggttcattaaaaacaaagaggaagtttgcatttttgttagaaataggagataaaatcctaaacaataaagaattttatgcaaatgatgatgttgaagttgtggttgattactcttttactgattcaaagagacctaaggagaagatagagctttatataatagaagatataaagagggattaatatggatttagaaggaaaatgctgcttaattcacgcaattggtggaattatttttggatatttggcaaattatgtatatactgctggtttggggatatttagtggaatagctactttgatatttttatttattggagctgtaatttttgggcatatttctgctaaaacatttggagaggagagtttaactcaaaaacagtggcttggttgtggagttctacctttctttttggtagctatagttgtttgggtattgaagtttaatgggctgatttaaatcggttattagaatatgatgaagaaagtttggaaatggtttaaaggctatggagctatatatttattgttaaggtgaaagctttgcttaataaagatataagggaggagattcaagcacttatagagattgcagaggagaatttatctgcagcaaaaattttatttgaaaataaattgtatagggatgccgttgcgagggcatattatgctatattccattctgcaaaggcgctattattgactaaaaatctcaatccaaaaaagcatgctggagtaataaagatgtttgggctttattttgttaatgaaggatatattgaagaaatatatgggagaataataacaaaaagttataatttaagatggaaggcagattatacaactgacaagccaactgaagaagaagcagaatcaataatatatgaggcggagatgtttgttgataggataaaaaaggcattaaaggagatattatgaatgaagaaaaagcaataaaagagtttgtgaatgcattaaaatcaaaatatagaggtagaattaagaaaattatactatttggtagctatgcaaggggagattacactgaagagagtgatattgacattttaatagttggggatgtggattttgattatgttattgatttatgcactaaattgctattgaagtatggagttgttataaatgcaattgttgagagtgaggaattatttaataaaaaaataaattggtcattccataggaatgttttagaggaaggaagagtgttgtattaagaataaaatcgatggttaattcctctccattatggaagaagttaatgagaaaatgtaaaggtgaaaatatggccttaaaaatggacaagtcaaaggaattatttgaagaggctaaaaaatatttggttggaggagttaatagtccagttagatattttaaaccatatccattttttgttgagaaagctaaagattgctatttatttgatgttgatggaaactgctatattgattactgcttagcttacgggccgatggttttagggcatgcaaatgatgctgtgattaaagcagttaaagagcaacttgaattaggaagtgcttatggatgcccaacagagaaagagattattttagctaaagaggttgttaaaagagttccatgtgctgagatggttagatttgttaattctgggactgaggcgacgatgtcagctataagattggcaagaggagttactggaaggaagaagattattaagtttgatggagcttatcatggagctcatgactatgttttggttaagagtggaagtggtgctctaacccacggacatccaaactctccaggaatcccagaagagacaacaaaaaatactatcttaattccgtttaatgatgaagatgctgtaaaaaaagcaataaatgaaaataaagatgaaattgcctgtattatagttgagccaattatgggaaatgttggttgtatattaccaaaagaaggttatttagagtttttaagagagataactgaggaaaatgatattttgttgatatttgatgaggttataactgggtttagattagctaagggaggagctcaggagtattttggagtagttccagatatagctaccttaggaaagatattgggaggaggatttccaatcggtgctattgtggggagaagagagcttatggagcagttttctccattgggagctatatatcaagcaggaacattcaacggaaatccaatatcaataactgctggaatcgccactcttaagcagttggatgataggttttataaagaaacagcaagaactgctaagatattggcagatactttaagagagttggctgataaacataatattaaagctaaggtttataacattgcttcaatgttccaaatctacttcaatgataaggaagttgtgaattatgagattgccaagcagagtgatactgagaaatttatgaaatacttctggagattgttggagaaaggggtttttgttcctccttcacagtttgaatgttgctttacctcaataaaacatgatgatgaggttgttgataagacaataaaggctatggaggatgtgtttgagggtttagaataattttaacttatttttataattttctcttaagggattcaaatgctgttagaaaaaagcaaaatagagattattgagcaatttatacatattttagaaattttagagatgtatgcaaaggaaggcagtgatgagaaggcaattataagattgatgttagattaccttgaaaaaggatatgttttagatgatgatatattaccaatagcaagcaaaatttcagaaatagctaaaaaagttggtagttttgatatgaagagggaaataagccttttactatttggagaaaggaaaagattaacaaaatcccaaaaaaataaaataaaaaagattattgagattttagagtatctaaagagttatatagagaagaagccatacaaatcttatgaagataaactcatcctaaatctaattggtttaaaaattttgaggttggataatgggattgttttagattataattccgaagttaggagcttaactaacatggctttaagagttggaagttatgaattaaaaaatgagattgagctattattaactggaagaagaaggagaaaattaactgaagaatttatacagaagagattgtcaattataaaaattttagagatggttaaagactttatagacaaaaaagaatttaaatcatcttttgattatgaagccctcttcttaataaatttaaagatttatagaattgaggaaggcattttaaaaaattttgatgaagagattgaatcaattttaaatattgccagaaaagtgggaaatcacaaattgagagagcagattgttttattaaaagagagtataaaaaattaaaattattctttatttttcaacttttcagtaattaattctgcacataatttccctgataaatacattccaccaaatattgcccccattctgtatccgccatgagaggcattggcagccattccacaaacaaatagatttggataaacttctcttgtgtttcttaataatgcattttctcccttttcagcccacattgatttttctccaggaacatctgcctctaacttgttcttttttacaaggatattaactattgaagcctcatgcccagtagcatcaactacaactttacttcttatagtcaatgggtcaatatgcaatccagccctttcaattgcatagctgtttataacaacccccgcaactccatcctctcttaaaattaaatcttcaacaacaattccagtcaatattttagctccagcatccattgctgcaactgccaatttggcaggaacttcaacagagtcagcaacgtaataaccatctcccatatcaattaacttaattccaacctctctcaacaactcatcagctggctcttcaacaacaatgtatgggaagcccattcctcctccccaggttcctccaccaaatgctaaatgcctctctaaaacaacgactttaaagccctcttttgccaaatatctcgcacatgttaaaccacttggtccagctccaactataacaacatcagcttcaacaatatctaaccacatatcaaagcttgccttcaatatagctttagttgtttttgtttcatctgcattcaactttatatcctttatattcattagattcaccatctgtaatttttaatattatttaaagtttagtttcaatattattttcaagatcaagtttttatacattttggaaattgaataatggtatcattcacaattttaaatctaatattactgagttaatatttcttttaataatccttctttaaccatttttaagtttaatataacaactccactattaaaactttcttttaatggattctttgctgtattccatccctttccatcagttatccatataaattgaacattattgttattgttttttataaattcatttaatgatctatactctccagcagtagcttttaactttgaacctcctccactataaaaattaacttcaatgagatataactttttagtgtttttattaaaaactgcaaaatcaaattttctatttgttttatccaatgttaaatttattccccatttttgttttattttatcttttgttgcttggaagatataatcaaggtttttattttgtttgcatagattttcaatatattttttaacaatattttccattaaatctccaattctatttttccttgcattggtgtccattcctacctcaacaccaaaaacataatccactaaattctttatttttctattttttaacaaatcctccaatccagtctctttaaaaaatttataatatctttcaatttcttcatcagttaaatatttcttttctttaaattctaaggtttctaattccatattttcgtttaaaattgttattttgttatctctaacagctattaaaattggaaaaacagtaataacctctggatactcttttagtaattcaaaaaactcctctttaaaattctcttttccaattagataatttaggatatgtaatcttttctctatcttttttatattattttcaattttttcccaatctacaaagaaattgtaggtttttatggtttctaagaggctgttaatgatgtattcaaaattcataaatatcccttaattattttgatggtttcttcgttaattcgttatacaattctttacaatttcttttttgccattttataaatctcatcacatttttcatataaataaactctattttgattattacgtaattcttttaatacttcataagttgcaccaattacttgctttcttccgttatatcccttcttttgtgagtatattctatcttcaatgattgcacgatgccagaaataatataataatgccctcaagtcattgttatttacactaaaattaacattattgattaggtaatcataaacatctttatctatattcatatcaagtattttacatagatggcataagaatttattaatttccgttggatctaaacaatcaactaaccatttccaagcatcattgtcataaactacttttttattccaatttttttgtgaatacgtaatttttattctgtaatctccacattcaacatcatatttatttttcttttttctatgataataacatgttcgagtacctttatcaaattctattatgatatttccaaaatttctattccaattaggaattcctgggactttatctggctcatctggatcccattctggatagggcttattctcttcaaatggctttatttgcattaaatcaccttaaaattattcaataattcataatcaataactcatatataccatcttttcttttatctcctttgcagttaatcatcctcttagcaacaaccttttttatattaaagccctcataaagctttccaaagaaatcaacattataagagttgcttaacatcaacttagcccctcttttatccaattttctataaaattttgccaatctaatttgatcatcatcgttaaaatcatactttgtataggatgtgaaggaagatgttttatttaacggcttatatggtggatcgaaataaacaaagctttcagcatcaacatactcatcaacaatctcaaaatctccacagaggattttaacgttctttaataattttgaaacatttttcaaattttgttcatcaaaaatctttgggtttttataccttccataaggaacattaaattctccttttttattaaccctatatagcccattataacatgttttatttaaaaatataaactgtgccactcttttaacttcatcacaatcattcttgtttttgttaaagtcatctctaactttataataaaattctttccttttttcttcatccaatgataaaaattcatcccttaaggatgataactcctcaattaatctatcgacatcatttttaacaactttatagcatagcatcaaatcctcgttaatatcactgataataacttttttaaattcgtatttttgtaaaaggtaaaataaaactgcccctccaccaacaaagggttctatatattttttaatgtttccttccttcaattcttttggtaaattttcttctatttgacttaaaatttgtgtttttcctccagcccattttaaaaaaggtttaacttccattttatcccaaaaaattagattaactggctttaatcttccttaaaactttagatacataactttctattctctcatttatattttctctaagctcctcaaccctcttaatattttcgctacttatatttatctcttcctctatgtatggggttttctctaacactttttttccagccaagatatcaatatctgtaaatgtccctaacaactctctaccagttgctaaaatctctttctctatccaatgagcttcctttgttccaaatactgaaaataatgggaatttggttattacattggagccactcataattaatgggcttatcattggaattttgtcaacccaaactccagtaataatcttaatctttgggaaattcaacctaacagaagaaacccagttcatatactctattgtagttactgatggtttgttttcataaatagttcctttttgtggatttagagagtagaaggtaattctatttaaatccaactcctcaattaaatttaataacttctcaatatcttcctctttttctcctaatcctaatattattgttatccctgtctttaaacccaattctttagcttttaataaattatctttaatcttatctaatggctttcctgggcaaatccaatccctatctttgcttacagtttcaacagcccctacaactccttcaattacatccaaattaatgttgtctaaatcaataactccaacattcaaatactgcctacatttttgaacataagccaccatttcagcaatatcatttatttctttgggtgtatagccataaccaccagagataaactctaatttccaaccaattcttttcattaaaattgcctcagctaaaacactctccaatcttcttcttgcctttcttgggtcttttattttgtttttctgtgtagccatgtagcaaaacttacatggctgttttagattacaataccaacctaaaaaaagagccctctcaaatgtaactgtatttccgaaatgttttgttgttaatttaaatgcctttcttgcattctccaatatttcttcaaccttcattttctctctcccgatagtcaatcttcaaacttcattatttaataatgaacttataagcttttggcttaaataatagaaaattaattatctatttgaagattgactattctcaatatatttctcaataacttttggagaaactcttgtttgaattcctaatctctctaatattatgttatttaaaatagcttttaatatctccttaccttcctttgattcagtaatctcatttaattttcttgtagttgctggagattttaatttctttaaaacttctgcaatctcttcttctgtaatccttccttttttcttttgatatattccatctgcaatctcatacaacttattcatatcaaatggcaaatattcagggattttatttaaaactgtctcatctattgatgccaataacctcgctatctcaatatcttcagtattttcatctatttttaattttttcactacgaaccattttttatgcttagccataaactcaattttatcttccacaatctcaccaaaataaaattttagacttaattgaatgttaaaaatggattataaaataaaaaaataaacaaaaaagatggatgttgagattttacagtttatataataatcaatttaagacttagatgcgaaggttatcattctctttaattaagtctctattaggcagtaactaatttctttaagacagggtctgttacatcctctggctttatttcctcaatatttaagatttttattctacttcttttaactttgtatcttcctccaaattcagagtataatatctctaaagcatcttctggttttaatgctttgtattcctttctaaagtataatgggtctttaccttttttgctcataattccagttattctaaatatcttagccaaattaccacctcctcattctttacaaatcttataaatgttttgtgcaacacctatccatcttaagtaggaatagatagatgcctttaatatagaaatatctttagctttaacatttatcgttattatatttttatttatttccattgtggcggaggattttatttgagaagttaaatgttccaaaaatatggatttatagataatttcagcctcttcctcactatcaaactccaatattaactcaaaagaattcatgaaaatccctttataaaaggctgtcaaacaacttaatagattttattctaatcaaaggccctattttaactctccctttataaaattgtatagcaaatagatattttgggtctttttccaacctcaatgttatatcactatcctcattaatatttaaatgttggaataaaaattcatcataaatttcatagtatttttgaaattcctcgttatctttaagttctctacttatttttattcttattccatcatcattatatattttctctccacaaatctctctctgtaatttaacagagataaagcttgatagtcttttttcattttcaacatcataaacaactaaagttccagggttagctttaaactcaccaattaaaagaacatgcttatcaatttcaaaaatctcctttaatgaaagcttccctctctgaacatagggaatatttaaagttctctctaaatctctcgcaaaacttcttgttctttgggagggttttcttgaagttgttagtatcattttatctcgcctttacatgtttaactacttttggtctaagtttaaccaatatcttataactgcagtgaggacatcttgctctttttcccagctcttcaagttttattatctttttacagtttaaacacttgtattctaccatatacatccccaaaaataaaagttataaaaatttataaaataataatgctaaataatgaaaagttattcttcttttctctcaacaattcttctaattgccttcataacagcctttcctgcacctgtttctggtgtgtatgctcctccagctatcttagctccacactttccacaaacccatattgatgttgaagctctctttaattttggaaatccacagacaggacatttatatttctttttagctttaatttcaacatctctaactctaactcttatttttaaaccatatcttggtccaaatcttcctgttggacctactttctttgtgtggctgaacatactctctcacctcgtctttaatatctatttaatatctataaattattcactgtatttcttaacaacctttgtttggacatttcctttggttattttatttagatgagcataaaactccgcttcaataccacttggtatttcaattaatacaattagagaaccatctggctgccattcttcctgcttaacagctccaaattggtataaagcattatatgccttagaagcgaattctgctgggattttaacagcgatatctctcttttcaaatctaataggtagaacttttttaagctttttaacaatttcagggacttgttcttcagcacttttataaatgtctatgttaattcttaactcttccattgccttttcaattctatgcggtggatgtggagtatctgtttgagggtttattgtgtttctactaattatggttataatttgcctctttttttgttctctaatttcttctctctgcttagcagttaattgaacttgaccttttaatataatttttttagcaatttctttaacatctgttgttccaaatatttttgatagtaactcttcaggggctttctcccctttacttgcatctctaaatacaacttcaatagctaaaagctcatcaaaatctacattttgcccttctttaagcttagccgctaaatatgggtcaactaaaatttcaaatttttcgccatgggatgtatatcttgctattactgcctcttctaaggacaccataatatccctccccacattatataaatgtttcggctaagggttttgaatttataaaaattactttagtgagagtgagtaggatactcccaaataatattaatactctaaaaataatttaaaatagttggatttaaaaattttactataatttattcttcttgtttttctttagtttcttctctattctcttcctctttcttattttcttcatttaatttctttttaactttttctataagtttttttatctcttccacaggaatttttttaaattgtgcgtctttaaccgttatgatacaaacatcaacattttcaggttttatgtcttcgtttgcttttgttaaagcagttatagctaattccaaaccttcatctaatgttatatcatctctatactctttctccaataattccataactacgggtcttccactacctattgctgttgctttatattcaattaaagccccacttgggtctgtttcaaataatcttgcttcatttttgtctattccagcaattaataatgaaactccaaacggtctaactccaccatgttgagtataagcttgtttaatatcacaaatctttttagccagcatttcaattgatatttcctctccataagttaatctgtaaatttgggcttctaatctcgctctatctattaaaactctcgcatcagctaccaatccagaggtagcagcagcaacgtggtcgtcaatttggaatatcttttctattgacctgatttttacgagtttgcttgttattcttctatctaccgctaaaactacaccatctttacaggcaatacctatcgctgttgtccctcttctcactgcctctcttgcatactctacttgatataatctaccttctgggctaaacactgtaatagccctatcataagcacttggaggtaccatttgcataaaatatcaccattataagtattttaaagtagttaaataattagcttaatgtttttaactaattcatctcattataatatcttattatttttattcttttcttttttatttttatttttatagtcttattttatatggttgtgttaagtattgacataaccataaattatatatatgagatataggattataataaaagtggtgatatggaatgaagaaggttgttatatctgatgaagctaagaaattcatcttagataagttaaagaaagctaatcaggataaagtagttatatactttgaaggatttgcttgaggaggtcctaagtttggaatagctatcgcccaccccaacgaaaatgataaattaatttacgataatgaatttaaagtttatattgaccccatagcagatcaatggcttgatgaagttaatatctcattgagaaggtcaatatttggaaagtatcttaagatagaaggtagtagtgagtgctaaccgggaacccaattttgggaccggttagcttctattattgtgtggatttatctgttttttcagaaataaattaaatttatttaattattcttgcatcacctatacatcctccctctttttcattaaagacaaatactgggtttaaatcaagctctttaatctctttgtgaatatccataaatactccaatctttattagggtatcaacaataaagttaatatctctcttaggtcttcctctaacgccttctaagactttataggatttcaattccctcaacatctcatgagcaaagtcccttgttattggcgaaatgccaaaagatacatcttttaaaacctcaacaaatactcctcctaacccaaccataactacagagccaaaaatatcatccctcttagcccctattataatttccatcatatctttctcaatgaactcttcaactaacactccctctataattaaattatcaatgcccattctttttgcatattccttagcattttcaattaattttttaaatgcctctttaggattttttggatttattataactcctcctgcctccgttttatgtattatttgtggtgagacaattttcattacgcatttacctaattttttgcaatattctaaagcttcatcttcatttttagctaaatagcccttaggaactggaagaccataaatgcttaataattttttagcagtgtattcatttggatttgataataattctttaataatttctttattttcttcagtaatttttatgaactcttctttaatattttctaagtattcatcataatcttccttaactttcattaagctatatttatagagatgagatagggctttgacaccattttctggagttatgtatgcagggattccattcttccttaaataacttttagctcctttaactgaaactcctccaacaaatgaagtaattaacggtttatttttaaattctttatgggaatttttaacttctataatagatttagcaacttctaatggttttgtcatctcttgtggagttaagataactaaaagccccttaacattgctatcttcagctaaaacttctataacctttttatatctctctggtgtggcatctcctataatatccaatggatttgatatattggcagttggtggcagaatatttttaagcttttctattgttgatttttcaaagttagatagcttcatgttataatcaacacagctatcagctgctaaaactccaaatcctcctgcatttgttattattccaatttcatttgagcttattgttggctgtgttgagaataaatggattaaatcaactaactcctcaaacgtatatgccctaattatcccagcttctttaaacgctgcctcatagataacatcttctccagctaaagagccagtgtgggattttgccgctttctttcctacttcagttcttccagattttagggcaattattggctttttcttagataattttttagctacttttaaaaatctcttatcctttaatccttctatgtataaaacaactatcttagtatcttcatcatctaaaaaatactctaataaatcactttcctgaatatcagctttatttccaatgctaacaactttagaaaagccaatattcaataaaggggctatgtctaatatggcatttaaaacagccccactttgtgagattattgaaactcctccttttggaggaaataccttcgcaaatgtggcatttaagtttatatgggtgttcattatacctaaacaattaggccctataattcttatgttgtatctttttgctatttctttaattttattttccaactcataatttcctacttctgaaaagccagctgtaataattacagcccctttaacccctttttttccacattcttccaataccttaggaacaacaatatttggaactactataactgccaaatctatgtcatcctcaacgtccaaaactgatttatagcattttattccgaatatttcatcatattttggatttatgggatagatttttccattaaagtcttttaaatttttcattattgcatatccaacctttccttcagtttttgaagctccaataatagcaactgattttggataggaaatatatttaagctcataatccctcccccacatttttcagagaaaaatttttatagtgatttttaatattctaattattatctcttttaacatttatatactctcacctcctaaacaaataacgattatggaggtgagattttatgagattaaaagctataaaaataacaagtagagatggggaaacattctttaaatgtccaagatgtggaaaaattttcagatattcaaaagattacacaagacatgtaaataaagctcacggccatctctttaaaaaagaataaagttattctttataaataagatttccatcttcattttccactatttttggatgtaactttagaaaagattttattgctggtggtatattccattcaacaccatgaacaagtttatcccaattttcaacaaacctctttttccctaaaacctcatccaactttcctctcaatttttcaataactattttatccttggtaaagctttttatcctataagcccctctttttgttttggagtaaaaaatcttatcctcatcatagtaattttttgctatctctaacaactctctccagacctctttaggtctcacactatcaccaaattaagatttaactaattactattaaagtattgtaggtgattatatgtattttttgattcagcagagaaaggaagaaagtgaaaaaaatttgaaagaaaaattaaaaagatatagaaaaaaattaagagacagcagaattaaagaaaagctaaaagaaatgccattaaacatgaataaatacttaactgatgcttatacaggaggaattattaaaaaatatccagaggattttattgttgaagagataactccagaaggaattattttagaagttggaaagagtatagaatttaaagatgaagaaaattggaagggaaattatatacacttcacattagagaagaggaattggacaactttagatgccattagagaaatagcaaacagagtaggaaagcagagaaagcattttggatttgctggcaataaggataaatatgccgtaactactcaaagagtgggctgttttaatgtaaagttagaagatttaatgaaagttaagattaaaggcataatattgagagatttccaaaaaacaaatagaaaaataaggttgggggatttgtgggggaatagatttactataagagttagagagcctgagcttaaaggaaaagaattggaagaagctttaaataagttatgtaagctaaaatacttcttaaattactatggtgttcaaaggtttggaactacaaggccaataactcacatagttgggaggtttattatagagagagactgggagggagctttccatgcatattgtggaactccccttccttacgatgacaaaaaatcaaagttggcaagggagttggtggatgaagagaattttaaagaggcgtataaaaaattcccaaaggctttcttttatgaaagaaggatgattaaagcttatatagaaactgggagctatcaaaaggcatttatgattcttccaccatacttaaggtgcatgtttataaatgcttatcaatcctatttattcaatgagataatcaatagaaggtttgagtatggctttgaacctatggaaggggatattttaattgataatgtgccgagtggggcattgtttggatataaaacaaggtttgcatctggaatacaaggagagattgagagagagatttatgagagagaaaatctaagtccagaggatttcaagattggtgagtttggttcatttattggagatagaagggcgatgattggaaaaatatacaatatgaaatattggattgaagatgacagctatgttttgcagttttgtttaaaaaaaggaaattatgcaacctctgttttgagggagtttatagaaaagaaggattaaaagattcagtaagaagttttaggaaaataataaaaataataaaaggaaaaattattgtgggatttaaatatctcttaaaaaattaggaaaataaaaaaataagcccccaatggtgttgccatggttaatgaatataaagcacactcttcattcatacttaaggttgtcattacacttattggttattggattgcttcgatattagcaattattatttattcaatgttttttaaaatagagactaacacctttttattgtgtttattacttccaacgcccataatctggttcaatattttaattggaatgggtttaacctatagatgtatggaaaacttaaccatttatgataagcataaactctggtgtgtatttgtcagagatttaacactaacaatattggctacaatattagcaacattaaccacaatggaattatatcaaatagaacacccattaaaaccaatcgaattcgtattcattgtaggattagttttaatcgtaggatttacaataataacaaccttaattatcaaatacctaaaaatcataaaaaatctaaagaaaataagtaaaaattaatttgcatccttcatatctttctcaaacttgctaaaataatagtaaaatattgccataactccacatataaaaacaagtattgctataactccaataatcaatggattaagttccatactcatcaacctctattttttactcatacttatttgatgtatttaaaataatttttggttatgaaattgtatttttaggggctacaacttacaaactgcttctggagttgtatcctttagtgtaggaacgactttgataatagtagatacagtagcaatattttttactgtttgggtattttcagccatattatacgatatttacaaaaaattaaaataagttaatcctctatcatctttctaccacctaatttaaaataccagatatataatcctactacaaaacttatgataactgcaaaagaaagtattgaaactaataaaaataagctttctccttccatattattacctcattatttcttaattttaatgaaatcacctaatgtaaatccatcttcatctctaccaccataatatgaagtttcttccccaatactttcagttaagcttatttttaactctttctctaatattttaatttctttttcatttggttctaactcatacctttcaaatttttgtaaagtacttgctttcattttaagttttttagcaagttcttctattgataaacctctcttttctcttgcttctctaataacatccccataatcctctcttaacattggtaaagtatcaaatatatctcttcttcttttaataggctttttaacttgtttattagtagttattgttccttttcctattatagtttttttacctaatcttgaatatgtttttggacttttgccaaatttagcacactctttacagacattcatttcagagccttcaataattaccttgtaaagcttatctgtaagctttccgcataactcacacatttgcataatactatccctcaaaaatttaataacatttatatactttggataacattagtttatattgttgggtataaataactaactggtgaaaatatggaaagggaaaaattaataaaaaagcttcttcatactttacatcatacagaggagcattttgaagctatactaaaccaattaaaagaacttggcttagaaactaaggattacgaagagctatacaacaaattaaaagaattaaatgagaaggttaaaaaagagttataaatttttaatacttttttattataaatttaactgccaaaccaattaatatccatccatacattgagattggtatagttattaaagggctgtagtaaaagcttccttctgcgcattcgggaacgataaatttaatatagacaaataaaggcagtgctaagatattaaataaccaattcggaattttaaattgtaagaatgggactatcaacccaaatattgccaagaataacaaaaacttatcttttctaagaatccataatgtagctaaaattatccctaaaattaagattgagatagcaataaaccatttcataaccttattgttatattcccaaatctcttcctgcattttccaatactcttcactttggatatatgccaaagtttcattatattttagattttgagattttaattcatgctgtttctctatcaattgttttagtttctctttatattcttcaatcctctcatcgtttggatttttactctctaattcttttaattttacagtaagttcattaatttctttgctgtaatttgagatattgtcatctatagcatttactaatgataaattagaaaatacaattaaaagtattaaaaaagctaattttttcatttcttcaccaaatattatcttatctgaggattattccagctatatagccacatattgttgagaatataacaactaaacccaaatatgttaaagccttcgtctttcctaagacttttgagatggttaagactgttggaatactcaaacttggtccagctaacagcagagccattgccggccctacacccataccaagctccatcaatgcctttataattggcacttctgttaatgtggcgaaatacatcaaagctccaataaatgaggcaataaagttggcagttatggagtttcctcctacataggttgctatataacttggtgggataattgccttaatagctccagctatggcaactccaataattagcagtggaaagacaatctttagcagtgtaaagctctctctgagccagttcttaatctcctcatctttaaaccagatttttgttgttacagccaagataatcccaagtattataaatagcagatgctttaataaaaatccatcgtatagaggcattgataacgttggaaacagcttgggtgaggcggtaattaccaacaacatgataaactgcagagcaaagaatgttattgtttgatatagaggcctatctgatattttatctgcctttgggactcttaaagctctctttttctcatggcttttaaatattatctccattgataaaccaataagtattgagactactactgcaaacacagcccttaaaaatccaatgtcccatccaagcaatgccgctgagtaaaatatagccaaaacatttattgctggcccagagaacaagaatgttgttgctggccctattccagctcctcttttgtaaatactggcaaataatggaaggatagtgcaagaacagacagctaataagctaccactaacagcagctacagtataggatatgtattttggtgtgtttgaaccgaaatattttataataaagttcttgttaatcattgaagcaatgcctccagccattaagaaagccatcaataaggctaagactctatttacatttaaataatcgatgattgtgtttatcataacattaataatgttcattataaagctcataacatccattttcatcccctcctaattctccttcttccttttaatgaagtataatcatgaaccatcttttctccacaatctgggcagtttggaagctctacctcagaagccatgcacgggcaaacatctaccttatatctcaacctctttccacactttggacagattaagttccaaacaatcatattttcaccacataatctataaatttgagttaattaatcaaaatatttataaaaataaatatagggttattccttattgtctccacaggtgcaaacaacttctcctttcttaaccaatgtatgagttccaaatacaattggaatctccaactcttccatcaacttcttacagatttcatcaaagtttatgtatgggcattctggctgtaagaaggtgcagtttgctatatgaatagcttcagctccagcagcagtttttaatagctttactctcattggaaatctccttccaggacaacccccacaggttgtaaatgcaactaactcaacatctttgtatctttcaaaagctccactcttctcatttattgctttaaagcaagatacgcatgcctctttcccaggacatcccatttcaaccattttttgacatgcgataattgccactttcattatttcccctctaagtaactttttaactcttccttaatttcctcaacagagggaatttttccttcaaagacaattacatcgtcaaatgctactccaggtgtaacaaaaacccattcagctatctcattgacatctgtaactttaacaatctctgcatctatgccaagttcttctactgcttttttaacgttctcgtatgtttggttacattttggacagcccgttccgaatatccttatcactaccataaccctcaccaattagtgtctttcaaaattaataaatttattaaggaaaatttgaacaccttcctaaaggaaggcgttcattaataccttaaggtattacaaaatgttttgaaagacactaaatattattgggttttaaaagtaatatttatagttttcgattaattgatatattttaatatttttaaaaagaattcaaatatttggataatatttcagtaaattttatatattttctcgcataagcgttgtaatattgaagaatgacgaaaattttaaaggtgaaattaatgaaaatagctctacctatagataacaatcggctatctccacactttggaaggtgtgaaaaattcatgattgtagagattgaaaatggagagataaaaaataaagagatcattgaaaacactgcaagaaatggcatgcatggagttggaactacatcagcctcattaattgcaaatatgggtgtaaatgccataatagtccaaaatataggacctaaggcatacagtgtttttaaacagcttggcattgatgtttataaagctaatacaacatctattgatgaatgcataaagctatttttagaaggaaaattagaaaaatttgagtgagatgatgattgttgcagtaactggtggtaaaggagggactggaaaatctaccttgtcagcaaacctctttttttattttattgagaattataaaactgctttaatagattgtgatgttgagacgccaaatcttccctacttaacaggttgtgaggatttattcttagcaagagaagtttttattgaagttccaaatatagaggagggtaaaacttacaactataataatgtatgtaaagaaggagctttattaaaagttggagataaattaatatttattgaggatttatgcagtggctgtaaagcttgtggaataaatagcaatataacatttaaaaagaagagcattggaaagatttacgagaaaaaatttgataatggatatctaattgtaggaaaatcaaacttgggagagagaaagacagcaaaaatcgtaactgaaacaaagaaatatggtttatcaaaaaactgcgaaattaacattgtagatactgccgcaggaactcactgtaacgttgtgagagcattaattaacgcagataaagtccttatagttacagagccaacaccttttggtgtttcagatgcaaagaggataatcaaggttgtggaaaagctaaatattccatacaagattgttttgaatagatatggaatcagtgatttaaaaattggttataacttcaaaattccttatgataagagaatagttgaatgctactgcaaaggagagagttttttaaaatataatgatttgagaaattatatagaagagattgcaaattggattatttggggataataatgaagatagcaattatctcagggaaaggaggagtaggaaaatcttctatttcaacatccttagctaagctgttttcaaaagagtttaatattgtagcattagattgtgatgttgatgcaccaaactttaacttaatgtttgatgttaaagataaaaaattgttggaagttatctatcgtgagatatatgagataaatgatgactgcataagatgtggaaaatgcttagatgtctgtcaatttgacgctataggggattttaagataaatccaatactgtgtgaaggttgtggagcttgtgagctaatctgtgaatttgatgcaatagagccaattaaacgtgaaagtggttatatctacgaaggttttgttggctttccgttaatttggggagagttagaggttggtgagagtggaagtggaaagattattgagcatataaaaaaccatgccaaaaaatataaagcagagttggggattatagatggccctccaggagttggatgtccattaatctcaacggttaaagatgttgatttagctttatgtatagttgagccaacaaaatcaagtgttaatgattgtttaagattaatagaaacactaaatttctttaatgttgaatatttaattgttgagaataaaaagggcatgaataacattaactacccattcaaaatattccattcaattccttttgattttgatgttccaaaattgattgcaaataagattttgctttgtgatagtaatagcaaagtatcagaatcaataaaagagctttatgaaaaattaaaagaatttatttagctattttttcttttaacaactaaaactggtttgtttgattttttaatgacattttcagtaactgaaccaagtaatatctcttttaagtttgtttttccatgagaacccattataattatatctactccctcatcttcagctattttaacaatttcttcatgaggaattcctacaacaataatatccttaactttaaatccaacatcttcaagttcttttttgatattttccattttatttttagcttcttcagtaagtttattctttagctcattttcaaactcctcaactgatttattcaaacctgcaacacctaagagtagagagaatatatctctctttttgatttctctttcatctataacatgcagtaaaataacttcttccgccttaagagttttaaacgccttaacatgctttaatgcaatctcagcagtttcagagaagtcagttggataaagaatctttttatacataacactcacccttttattaatgacctttaaacacttctccagtataaactttgtttgttgtttttattaaagttatcgcccagaagaagaataacaaccagtataatccaaagcctatgtaatcgattatactaaatttgaatattttataaactaaatgtgatgatgcaacataagctcccaatgggaagatgaatgcccaccatgacattgcataaggaagttttagctttttaacatagtagagagtcattattatagccatcaaactccaccataatccaaacccccagaatatgaaggagaagatataaaacggctcttttattgttatgaatggggagttattaaccatgtttattaaggcaacaattccagcccctattggccccaagttaatccatactgttggagccattgctgagggtagaggatgatgcagtataaacctataaattaccactgctaataaagctaaatataagaaaaatccagccccccaaccgaagtagttaataagaactgttaattcatgccaaactccagttaaatgaggcattatcaaactcccggcaattggaataactatcaaaccaacaggtggaatataccaacccggattaacatggtctaactttatactttcagacttaaacatataaaacggaactatcaaactgaataaaaacatgccaatagcaccaagagtccaaaatactccaccccaaaacatattatgccctatatttataaagtcagctcctaaaactaaacaactaactgcaatggttggataaaaggcactcaaaactggatgctttaaatcagctaaagcattatctttgaacataatccatcttaaaacccagggaactaagaatataaagaacaacaaaacattgaaataaaacaatccaactgcaacatcttttaaaattggcaaataagatgaatatagtaagctatcaactgctaagattccagttcccatcactgcagcaaaccatgaagggacgaagtttttaattatgtctaattttgattcacacgcctctaacatgctctccctcttttaaaatatccacttatgggtaaaataaaatacacaacaaatatttatagttttcgattaattgatgtattttaatgtttttaaaaaagatttaaatatttaaatgaaaattatcccttctaaaacagcctctttgtgtatgtttaatgctttttgctttctacaatctcctctaaaaatttttatcttcccagcaacgcatggatatctttgaattagcatggcagattttttggcaaattcttcaatatcattaacctccattcccttcatcagcttagccataaataaggttgaaccgcagatagatgttcttaaaacctccacatctataactttgttgtctttaacataaaccttaacctttggagttccaaattcttctaaaaattcttttaattttggatatttatctatcaagcttccaacctcattttcatccaacaaacacatctcttctggacatatagcatcaaacttctttagctccttcttctctccctctccactccacgtagcaacgattatggcaatatctttattcaatctccttgcctcatagcagagataataggtgttgtctggatgttgagtataaagcaataaaatatcagcctctttaattttttccaacaactcatctggaaactctatatcatcaactatcaaatcatctggtttgttgattttatagattccaatgaatttatttttctttccaaaggagtttattgttcctttaatcctgtatccataagctccatcagttactaccaatatttttgccattgttatctcctttactcttagagtttcttttagataacagatagtaaattattgctccaattatccctaaaaaccagacaaccaatatccataagattttttcaagagtatctaaagcatccctctttaaaatatccacaatggtaataataattattataaaaactgctattccaataacaaaaaacaatcccataaagaaaaatccaaaaattggaaatccaaccattccaaaacctattggacaaggccacataaatatcccttagttattcaaatgagacaaatcctattcaaggatgacattcttctcaatctcacagcttatagagttgcttattaaacatttttttgagccttctaaaactaatttctttaatttctctttgtctatgtctccatcaacttttacatagatgtttataattaccttctttatctttccttcttcaaaggatttctcaacctttccatctacttttatctcagcatctatgttgttagcttttaatgtattaccaacagctatgcaaacacatccacaaagcccagctaaaaacaaatccattggggatattttttcctttattgccccttttcctcctcttgaatggatttttaaacctttaacatttagtagggcttcaaacatatccaaatattcagcagaaacttctttattctcatccttgcttacaattatatcaacaattcttgctataaactcctttctttcattttcaggaatatattgcaaaaacttctctaaagctaaaggcatcatctttggcatcattttaggagccatttctttagcaatgtctgaattcatcatctccataatcatctctggattcatatccccacctcattattttccgcttatgagtaaaaatatattaggtaatatttatacctttcgattaattaatacattttaatatttttaaaaaagatttaaatatatcgataaattttaaaataaaataaagaagtttattcatttttcatcatcagaattatattttttatgcgtcagatgtttttcaacagctaaacctctaaaaaaacactcccttgcttcctcatacctccccaaaattctcagagctaaagctttattaaaccatgcatctctataaaatgggtttaattctattgctttgttaaaatactctaaggctttttctacatctcctttatttccaacttctacaccttttttataataatactctgcctttttaatattttcatccatattaacaccctaaaaattaaaaataaaaaataaaagattttagctgttagttttttcaataaacttctcgtgcaattttctaacacaattcaacaaatccttttcatcaataacaaatgatatattcacttctgatgaaccttgagctatcatctttatatttgccccgctttcagaaacagcagtgaatatctttccagctatgcctttagctcctctcattccagcccctacaactgaaataacacaaacatctttatcaacactcacatccctaattaagttattgtttaaaaagctcttctttccaaaatccccaaactctctctttaatgcttttaatgctttatcaacatcctcctcacttacaacgagggatatatttgtttcagaggaaccttggcttattaaaattacattaacttcctcttctcctaaagctttgaatatccttgccgctgttccactaactccaaccatcccagctccaaatatgtttattaaagcgacattttttattgttgatatagctttaactatgctatcactcatctccatatcgttggttattaaagttccttcactctctggctcaaatgtattctttaccaatattggaatgcccttctccatagctggctctatagttcttggatgcaaaaccttagctccaaagtatgctaattccatagcctctatgtaactaagttttggaattcttcttgcagtaggaactaatcttgggtctgttgtataaactccagaaacatctgtccaaatttcaataatatctgcatctaagccataaccaattaaagcggctgagtaatcacttccgcctcttcctaaggttgttatataaccctcttcagtggttcctataaatcctgtaaccactggaataatgccctcttttaataatggtaacaatctctctttaacctctaatcttttaactcttgcacttccaaagttgttatccgttattattcctgcttctcctccttctaaagcaatagacttttctcctaaatctctaatagctccacttaatattggtgaggacaacctctctccaaatgataatatatagtctcttgactttggtgtaagctcccctaagtatgctacaccaattaaaaccttctctaattcttcaatcctgctgtcaattattttttttacttcttctttaatttcttctgattttatagcttcttctatagctttgtagtgtttctctctaataaattttataaaatctcctacttttgcgatatctctaacatctaaagcttgctgagatatctccaccaatgcgttagttacttcactcattgctgaaactacaacaaccacatcatcatcctctttttttctctttgttactattttcgccacatgcctaattctttctccagaacctacagaagttcctccaaacttcattactgttgtcataacttacaccaaaaattattttataattgataagattaaccacacaaaattttagaccatgtatatttaaaatttttctttattggggagttaggagttattggagcatctttttattaaccttttatatttttagttcataagctaaaaagagaatataatgttctatttttaaatttgattaaaactatttaggaaaagctttctcttaaagaagtttaattatttttattctttatactaaaaatatttgaaaaaatagtgaaatataatttttcttagttttcatcctcttagaggtctgattttaattataaacaattttgggaggtagaaggaaaaagaactatgtttccattccgaatcagtctgattttaatagacatgaaccaaaaaaatctcaattagatttagttgtttccattccgaaacggtctgattttaactcaaaattaagatgatagaaacattattaaaataaaaagtttccattccgaaacggtctgattttaactcaaaattaagatgatagaaacattattaaaataaaaagtttccattccgaaacggtctgattttaaccggtgttgatgctatagtttatagatttgaagaggcaataaggtttccattccgaaacggtctgattttaacactttaataacatccactccagagattctcattcttgttccatatttccattccgaaacggtctgattttaacgattagttttgctgagtttccaaccttttcggggggtttccattccgaaacggtctgattttaacttgtagaatgttatttgcctcttctgcactcatgttttggtttccattccgaaacggtctgattttaacaagtcatttgtatttagtttctgtagagaattgtttccattccgaaacggtctgattttaacgcttgttgcaatatagttaagaaatcttcatttacactgtttccattccgaaacggtctgattttaacttttatttattcttttattttttggagggataaaagtttccattccgaaacggtctgattttaacaatttatatataaatccatatataaaaatttcggtagttaaaatcagagtttccattccgaaacggtctgattttaacagggcaatcattcacaacataatatacttcatcactcttaatatttaagcttttctataccatatttttctaagggtaaataaccatcttacaatataaaccttttagtatttaaaattttatctctttactaaaactaagcatttttatctttttaaattcaaaaatttaacttgtctgttagagaaatcttatttagataattatttaatttttattttcaaaaatctgaataattcaataaacttaaatattctaaataatcaaaccagcaaacccttagaaattaaataaaaatcctttgaactaattaataacttctaaatgctcttattttcaaattctaaacttatccaacaagacaatcaataaaccaaacaacaaaatcagaaattccaaacctatatctataataaaattatggtaacaaaaaatatatactttactctatatttttataaccaaccaattttatggtgattgtatgaaagtcgctgttttgtattctggaggaaaagattcaaactatgcactatactgggcattaaaagaaggttttgatgtaaaataccttgtaaatgttgaaagtgagaataaagaaagttacatgttccatattccaaatgtgcatttaactgagttaagtgctgaagctgtaggaattcctctaataaaactatacacaaaaggagaaaaagaaaaagaagttgaagatttaaaaaaagggcttgaaaaattagatgttgaggggattgttacaggagctgtggcaagtatttatcaaaagtcaaggattgacagagtttgtgaggaacttggattaaaatcctttgctccattatggcacaaagacccagagtggattttaagaactgttagcgagctttttaatgtgagaattgttggtgtctatgcttatggcttaggaaaagaatggttaggaaagagaataaccaaggaaaatattgataaattattaaatatctgtgaaaaatatggaatacataaggcgtttgagggaggagaagctgagacattcgtttttgatgctccaatgtttaaaaagaggatagaggttgttgaggcagagatagaatggcatgaaacttggggaatttaccatataaaaaaggcaaaattggttgataaagaataaagggagattatgattagaatagggacaagaggtagtaaattggcattatatcaagctaacaaagtggctgaactattaaaaaatcttggttataaggtagaaataaagataattaaaactactggagatagggttttagataaaaagctatcggatataggtattggcgtttttacaaaggagttagatttagccatgttaaataacgaaattgatatagcagttcatagcttaaaagacattccaactatttggaatgaaaatttaatggttggggctgttttggagagagatagctatcacgacttgctaatatggaataaggatatagattttaatgaagatagtaaaatagttataggaacttcaagtatgaggaggagggcttttttaaagtttatttatccaaatgcaaaatttgagttattgaggggaaatgtagatacaagattaagaaagctaaaagaagggctttatgatgctattgttttatctgaagctggaataataagattgggagttagtttagaggattttaactataaaagattggatatccttccagctcctgctcaaggaattatagccgttgcttgcaaaagagatgatgaggaaatgaaaagcatcttaaaagagattaaccatgaaagaacttacttagagagtttatgtgaaagaactgcattaaatgaatttggaggaggttgtagtgttccatttggagctttagcagtttatgatgaaaaaaatgagttattaaaattaaaagctgcagttgttaccaacgatgagttaaaaaatgcctctggagaggttaaatgtaaaattgatgagattgataaggcagttgaattagggaaaaaaattggactaaaattaaaaaattaaactttatctttaaatttctccataaaaatttttaatctctctaatatttcatctgataatgcatgttctaatttgcaagcttcttcagatgctgttttttcatccaatcctaaaaactccactaaaaatattttaattgttttatgtttgtccaatatttttttagcctcttcaatgcctttttcagttaaagttatcccaatatatggctcataattaacataacccaatctatgcagtttttttgccatatttgtaactgctgatggctttatatttaacaatttagccagttcagttgtttttattggtctgttattttcttttatgaataaataaatcctctctaaataatcctcaatactttgagacatgatgccaccgaaaggtttttataccctgcatgttattatttaactacggttaaaaattttaactataattaaatcatttaaccatatataaatgttgtggtattatgtatccattagcatttgcaaaagagggagaggaagttatagtaaagaaaattgacgctggttgtggagctatgcagagattggtaagcatggggattaatataggaagtaaattaaaagttataagaaatcagaatggacctgtaataatatcaactaaaggaagcaatatagcaatagggagaggtttagcgatgaaaataatggtagaggatgctgagtatgggggagagaatgaaaagctatgaaatagctttaatcggtaacccaaacgttggtaaatctaccatatttaacgctttaactggggaaaatgtatatattggaaattggcctggagtaactgtagagaaaaaagaaggagagtttgaatataatggagaaaaatttaaagttgttgatttacctggagtttatagtttaacagccaattctattgatgagattattgcaagagactacataataaacgaaaaaccagatttagtcgttaatattgttgatgctactgccttagaaagaaatctatatttaactttacagttaatggaaatgggggctaatttattgttggctttaaataaaatggatttagctaaaagtttaggaatagagattgatgtagataaattagagaagattttaggagttaaagttgttcctttatctgcagctaaaaagatgggtattgaagatttaaaaaaagctatatctatagctgtaaaagataaaaaaacagctgaaatcaagtatccaaactttgagccttacattaaaaaaataacctctattttacagaaggatgaagatttaaagaagtataatctgagatatttggctataaagctccttgaaaatgataagtatgttgaagagattgtaaaaaatagcaaagtttggaatgaattaaaaccagtattggatagtattataaatgaattatctaaaaaatatggagaggcagaattggggatagttgaggagaggtataaggttattgataaaatagttaaagaagtaatgaaaaaaacttctggaaagctaacaactactgaaatgcttgatgatgttttaacagatgaaaaaataggaactttattgattatcccatttttatggatgttgtttaaatttacattcgatgtttcaaagccattttcagccatgatagaatatttctttggatttttatcagaagttgtaaaatcctccatatccaataaatttattgcctcattattagctgatgggattatttcaggtgttggagctgttttagtgttctttccaatcttggcatttttattctttgccatatccttcttagaggatagtggatacatggcgaggattccatttatcacagatagaataatgaacaaattcggcttgcctggaaaggcagttatctcaatggttatgggctttggatgtaatgttccggcgataatggcaacaagaaccatagaggatgagaaggataggattttaactatattaataaatcctctattgtcttgttctgcacgactgcccatatatgcactattcgctggagctttattctcaaaatatcagggagttgtaattttaagcatgtatgcccttggagttgttttagctttaattacagcatttttatttagaaagttgatttttaaaacttccccctcatacttgattgttgaacttcctccctatcatatcccacatttaaatgtagttctaaaaaatacttgggagagagtttatgactttttaagaaaggcgggaacaattattgtatttggagttatcttagtttgggttttatcagtttatggaccttcaggatatttaggagaggaagtatttgaaaatcctcaattaatagctaattcatgggttgcagttattggaaaaactttagctcctttattttctccaatgggatgggattggagggcttgctctgctttggtgtttgggataatagctaaggaggtagttgttggaagtttggcaatgttatatgggactggagaggaaaatctctcatctgttattgctcatgcattctctccagtatctgcctatgcatttatggcattttctttaatttacctcccatgtattgcaacattagcagttataaagcaagaaattgggtggaaatgggcgttatttgcagtaacttatgagatgatattagcttatgttgtagctttggtaatctccgttattggaaatctattattttaataaggtgattaattatggacataaagaatatgagaaatgtaattgttagcttgtctttggtatttggattactattcacagtttctgggattattgaaataataattgggctttactcaatattgggctttaaaattgaattgccattatttgtaggagatgtatttggtggtttagctttattagctgttggaatagcatattttttaggtgtaaaaaaagctgtggatagggatataaaagcagtttcttatttatttactgcttctattattggtttgggaattggggttattgcatttttgattttaatatctgatgctattggatttttattggggtttgaggattgggcagattggggattttttaacgatttaactgtatatttagttttaggaatgcttgcgataattccatacagaatagctaaaattatctcatcatctacaacatagagaagaaaaataattattttttagttgctatttttagtttttaaaatagtttttgttagcctccaagaggtcttattttaatttatgatagttacaatttgaaagtagaagtatttgaaaagtttccatcctccaagaggtctgattttaacattgggttagcaatctaagattttttacggcatcaagttttccatcctccaagaggtctgattttaacttgaagcagaggatgccaaggaagctatcgaaataactttccatcctccaagaggtctgattttaacctgcctcccccaacacacgcacacacacctttccatcctccaagaggtctgattttaactctgccctccctcatcgttagattacctcctttaactttccatcctccaagaggtctgattttaaccccgtccatattccacaatcccaataccagcccccactatcctttccatcctccaagaggtctgattttaactaaaaagtatgtaagaaatcatcaaaatattttcaactttccatcctccaagaggtctgattttaacagggcaatcattcacaacataatatacttcatcactcttaatatttaagcttttctataccatatttttctaaggataaataaccatcttacaatataaaccttttagtatttaaaattttctccctttaataaaactgagcatttttatctttttaaatccaaaaatttaacttatttgttagagaaattttatttacttacctaattaatcttaatttttaaaaatctaaataatttaattaagttaaatattttaaacaatcaaatcagctaacccttagaaattaaataaatattatttaaataaagaaataattcctaaatgctcttattttcaaattctaaacttatccaacaagacaatccataaaccaaacaacaaaatcagaaattccaaacctacaatagattataggcaaattcatatacaaacatttttgtcttctttcttatgaaaattaatatttaaatataacttataaaattatagctacttacctaccatgtatctcacaaattaataaaatttatttatgaaccacttaaaatgttttaagaggtcttgaaagatactaaaaactgcaatcattaaaggtgatgggatgaaacataattataaagtaaaattatttgatgaacttggatttgtaagaaagaagtgtaagaaatgtgggcaatggttttggactttggatgaagagagagaaacatgtggagatgcaccttgtgatatctattcatttattggaaagccgataactaaaaagccatatacatacaaggaaatggttaaagagtttataaacttctttaaagagcatgggcatgaaccaataaaaagagctccagtaactgcaagaagatggagagatgatattttattaacaatcgcttcaatagctgtgtttcagccatggatcaccaaaggaattgtaaaaccaaaggcaaatcctttagttatagcccagccatgtataaggttgaatgatattgacaacgttggaagaactggaaggcatttaacatgctttacaatgggaggacatcatgcttttaacagagaagatgacttcaaatactggcaggatgagacagttgaactctgctttaacttctttaaaaaattgggcatagatgagaaatcaataacctttattgagagttggtgggaaggtgggggaaatgctgggccttgctatgaggtaataactcatggtgttgagttagcaacccttgtttttatgcagtatgagaaagttggagataactacaaagaaattccgttaaaaatcgttgatactggttatggtattgaaagatttgtctgggcttcaactggagaaccaacaatatacgatgccatatttaaaaatatcgtcaataaattaaaagaagatgcaggagttaaagatatagataaggagatattggctaaaattacagaagttgctggattaatggatgttaaggatgttggggatttgagaaagttgagagaggaagtagctaacaaagtaaatatcccagttgaggagttagataagttaatctccccttatgaagacatctatgcaatagtagatcatacgagggctttggcatttatgttgggagatggaatagttccttcaaacgttaaggatggttatttggttagaatgcttataagaaagacattaagacatatggatcggctaaacctttcaacaccaataaccgaaattgttgcaatgcagttgaatgaactaaaggacttatatccagagttattggatatggaagattacattatggagattttagaaattgagacaaataagtatagacagacaattgaaagaggaaaaggaatcgttgaaagattattaaagagcaaaaaagagattgatttagagaatttaattgagttatatgacagccatggcttacctccagagatcgttaaagacgttgctaaatcgttaggaaaagatgttaaaattccagacaacttctatacaatagttgcagagagacacgaaaataaaaaagaagttaaagagaaaattaaacttccagaagttaatgttgataagacagaactgttattctacgaatatccaaaaatgaaagagtttgaggctaaaatcttaagaattgttgatgattatgtaatcttagatagaactgcattctatccagaaggtggaggacagaaggcagatactggatatataataaaaggagataagaagtttagagttgttgatgtgcagaaagaaaataatatagtttatcataaaatagagaacttaaatgatgaattaaaagaaggagatattgttaaaggagttattgattggaagagaaggttaagtttaatgagaaaccacactgcaacacacataataaatgctgcagctcagaaggttttaggaaggcatgtttggcaggcaggttcagatgttgatgtagataaagcgaggttggatataactcactataagagaataagcagagaagaactgaaagatattgagagagtagctaatgagattgtcttaaataattataacataaagagtatatttatggatagaaatgaggcagaggagaaatttggatttagaatatatcaaggaggagttgttccaggaaatgttttaaggattgttattattgaagatgaaaatggaaatatcgttgatgttcaagcatgtggtgggacgcactgccaaaacactggagaggttggatttataaagataattaagacagagagagttcaagatggtgttgaaaggctgatttattcaagtggcttaagtgctttaaaagcagtgcaagagatggaggatatattagaggagagtgctgagattttaagatgcccaactgaagaactgccaaaggttataaagagattctttgaagagtggaaggagcagagaaagaagatagaggagttagagaaaaagataggagaacttaagaaatttgaattaataaataaatttgagacaattggaaattacaaagttttagttgagaaagttgaggctaatccaaaagagatgttgaacatagctgataacttagctactgaaaatgccatagttgtgttattgaatgataagggcaatatattatgtaaaagaggagaaaatgtagatataaaaatgaatgaacttataagatatattgcmaaaggaggaggtagagagcatttagctcaaggaaaatatgaaggagatgtagaggagattaaaaagaaagttattgagttcattaaaaataaataaatttgctttaacgattaatttaatttttcttttttggtgagaatattggatatgaagcgtttaataaaatcatatcggattttttcattcatattaataatggacataattggggctgaaagccccaacttaatggaacgagttttgatgaaaccgaagcgttagcttcgggctacaaaaactcgaagagtttttgttcaacttttactaaaagtttcggtgagaatatgaatgttattgatttattctctggatgtggaggtttttcaaaaggttttttagatgaaaacttcagaattttgggagctatagagaactttaagccagttgttaaaacttatttatacaatataaaagcccctgtctggatggatgatataaagaggattcctccgaaagcgtttgatgaatttataaaaaatgagaaagttgatgtaattatcggctctcctccatgtgagccatttacaaaggcaaataaattaattaaagacaatccattagatagattatataaagacaaagttggtaggttagttttgtattatatagattatgtcaattactttacacaaagaaatgatgatttaatatttgttatggaaaatgttccacaaattaaagaaattaaggatgaactaaaaaagttgtttggagatatagggcataaggtttattttaatatattaagagcagaggattatggaaatccatcaaaaagagcgagaatgtttatttcaaatataaaattaaagccaaagaaagttgataaacttgttgttgtagaagaagctttaaaagacattccaaaagacgcaaaaaatcatgaaattaaaaagttatctaaagaaaaagtagagatgatttcaaaattaaagtggggtgaggcattatatagatatagaggaaagaaaaagttaatgtttaattggtataagttgcatcctaaaaaattagctccaactgttaaaggaaggagcaggtttatccacccttatgaagataggttattaactgtaagagaacaggcaagattgatgagttatcctgatgattttgtattctttggaggaagagatgttcagtataatcaaattggagaaagtgttcctccgatactgggtagggctatagctaaagaaatcaaaaaacagttataattttgatgaaccttttactaaaaggtttgaataagcagtccattaaaacaagaaaggaaatcctattgaaaaaactaaataataagctacaaatatggtttaaatcggtaggctattaatataatgataaaaacaagtgatagggatgaattttaaggacccaattgaagaattactagacaattactttaatgcaaaaaaagagtacgaaaaaaatccaatagaaaaaaatttaaataggttaaaaaaggcagaagctaagttaatgattaactatccaaatactaatgcaacatacatttacaaaaataaaaaatacaagataattataaaagatagcgtttcagtaattccgatttagttaggcatggtttatattaaccttaaaaaagattatctaatataatatgaaatttagttaaattttatagctcatttcttaaatcaattgtttggtgcatttctggacctgtggagattatagttactggaactccagtaacttcttcaatcttgtttataaattctttagctttttcacttagcttattatattcagttactccataacactctttatcgtatttatctaatccagttaaagcaatctgtgttgctccattcaacctacaagctttccttgctaattcaaagtcaaaatagccaactcttctccttcttccagtaactgttccatactcaacaattcccaagctctctgcctcttctaatgacatttcagttggaaatggcccagcaccaactcttgtagggaaggttttaaagacaactataacctcatcaacttttgtagggccgattccaacatcagcggcaaatgatgaagctgttgtatccttggatgttacataaggataggttccataatataaagagagtaaagttccctgtgttccttcaattaaaacattttctcctctatccaatgcattattaacctcttcagagacatctcctaaaaattctttaagctcttcaatatcctttgcctgctttaaaatcctcaacactctatcaacgtttgcagggccacagccgcttccagtagttccaatctctttagccaagtgctcatcttttctgtccataattttatgcttctcttcaataattccacatctataatctacaatcaatctctctttaacattaaagtctttaagcatctctacctcttttaacaaaacttctggatctaccaaaacaccagcccctatagccaactttgcctctttgtatgggaatcctgtaggtatcattctaattccataactttttccaccaatatttacagtatgcccagcgtttggtcctactcctcctcttgcaataattgatggcttgtctttatcacaaatatagcttattatctttccttttccttcatctccccattgtcctccaacaataatggtgcaagtcaataaaaccacctttttcactgttcaaaaccttatatttttttgtaattgtaatatttaaagttaattaatattaagaatttccaatgtatggcaagtaagttattataagttttttatagttctatatattttggaatataaatagtataacatagataaactccttccattaggaaggagttcaaatttactcataaatagattttattagttttgaaaagaaccatataatttcacaaaatgataaataatttaaaccttcaaataataaaccataacaaccccccagtgaaaatgaagtgatgataatgaaatttgttagattagaatttatatcttatgaggagtcatatgattttgaatttatggctccggatgacatcactgaagataagtttatagatgacttgtcagatgctatagtgaaaagcataaattgggagtatataaagggatactttcaagaagaagatgaattaggtatggaaattctccctaatttaatagactgcattgattttaaaaatgtgaatgtagaaatggaaaagaaagggtataaacccataaaatatgacatcattgtgtatgcaggggcatggtcatattttaatccaaaaaagttaagtattatcgactttcatgaaacaggagaattgacaaaattagaaaaagcaattcaagagaaattaaaaagattaaagacagatatttattaaattatgtttcaaactacatctcacaaagaatcttcccatatttttccttaaattcatctaaattcttgatagttgtatctaaagttagaggagttattgagatatgtctcttttttcttagaacataaacatctgtatcttcctcctcttcaaatatcggatagccatcaatccagtaataactcctccctcttgggtctattctctcttcaacatgtgttgtatacatctttcttgctaatcttgtaatttctataggggtttctaaagttgcgttttctggaatgtttatatttaaaacatcacaaggcatgtcataatctaaatatttctcagcaatttttgcagttatttttgctgggatttcaaagtttattggtatatccaactctttaaattttaagtggtctgaagttatttgtaatgaagaagctatagatttagctccatgatgagcagcttcaaacgcagcccctaatgttccagaagtcattatctctgtccctaaattctctccaatatttatcccagaaataaccaaatctggaactttttttaatatttgatatattcctaagattacacaatcagtaggcgttccagaaactgcataaccgacaatgtcctttgctaacttaacctttgtcatcctcagcggttcaaataggcttatagccctaccaatcccactctgctgatttgttggagcaactatggttatgtttgcatcactaaacttctcttttaaagcattgtataatgctatcaatgagggtgaataaatcccatcatcattaactattaatatttccataatatcaccaattaaagttatctttaacatttaaatactataaaaataatatttactcttaaagtaattaaaacttttggggggtaaaaatgaaaaaaagaaatataactgaatttcaagttctatctgaaattataagaaaacaacctcatataaaacagaaagaaatagctgagaatttaggaataacagttcaagcagtttcagaacacataagaaatttagttaaagagggttatgtgaaatcaaggggtagaggggagtatgtagttactgaaaaaggtttaagaaagttaaaaaactggatatcagagtttaaagattatttggatgaaataaacactgctgtttatagatacaaggatatatggccagctatagctgatgaagatgttaaagatggagaaacagtatatttgtttatgaaaaatggtctgttatatgcatcaaaacagccaaaaggagaagcaaaagcaaaggcattgtatggtggaaagaaaggtgaagatatagccatctgtgaaattaaaggaattattgatgtgcctaaagggaaagttattgtatttagaattcctcctgaagtcgttggtggttcaagagctgtggatttcaatttgataaaggagaatatcgataacttagatgattatgtcattgctactatgggaaccgttgcctatgttgttgcatgtaagttaggacttaaaccagacataagatttgccgttcctgaagctattgtaaatgcatgtaatagaggttgtaatgttatcgctttaataactggaaaaatggctgaaaaagtcattaaaaagcttgataatgcgaaaattagctatactgtattagatgccacaaaagaaaataaataatgaggaaggaaaatgacatataatataattttagctaaatcagctcttgaactaatcccagaagagataaaaaataaaataagaaagtccagagtttataaatatgatattttggattctaactatcactataaggcaatggaaaaactaaaagataaagagatgagaggaagaccagatatcatccacatatcacttttaaatatattagatagtccaataaatcatgaaaaaaagctaaacatctatattcatacttatgacgataaggttttaaaaataaatcctgaaacaagattgccaaggaattactttaggtttttgggagttatggaaaaggttttaaaaggagaaagaaatcatttaataaaaatggaagaaaaaacgttagaagatttattaaacgagataaatgctaaaaaaatagctataatgaccaaaactgggaaattaactcatccaaagcttttaaaggaatatgatacttttataataggcggattcccgtatggaaagttaaaaattaataaagaaaaagtttttggagatattaaggaaatctccatttataataaaggtttaatggcttggactgtttgtgggataatttgctattcattaagcttttaaaattttaaattatatttttattagatggtaagtttagaaatttaaagtgaattaatagtaacaataatttatttaaaccatgacaacaaaattcttaattatggagtgctttacattttaatagctcaatactgcgattttggtagatttctatgaaataaggggagatattatgtcaaaattcgtgaaactacacttagtaagaacccttaataaatataaagagctacaaaaaattagggtaaaagatgtaatgatatctggtgacgtaatcataacaactcctgaaaaaacgataaaggaaatatttgatgaaatgattaaacacaacattagcggaatgcctgtagttgatgataggggggtaatgattggatttattacactaagagaaattagaaagtatatgacaagtcatccatatcttaatgtgggggaggttatgctaaaaaatcctccttatactactgctgatgaagatataattacagcctttgaaaaaatgatagaatccaataagaaattagaccaattgccagtaatcaatacaaaatatcctgaaaaaattcttggtaaattggaaggcattatttttatggaggatattataaaattgctctatgaaaatattataaaagagttaaaaactcttgtaagtttctacaatcacaatactgagattaagataaaatattaaagctaaaaaaagaacttagaataattaaaaatacttttagaagaaattattgacctcttttatgcaattataaaccaattccacagttttttctaaatctctcttatcaataacttcaactggagtatgtatatatcttgctggaacagagataacaccagttggaattccctctcttgttaaatgaatggctgttgcatctgtagttcctccctcaccaacttcccactgaacatctattttatacttttcagaaacagctttaatcatatctaagacttttggatgagctatcaaccctctaccagatgcatctactattccaaccactggccccttacctaaatctaccggagcatcttcttttttaattcctggatggtctcctgctatagtaacatctaacgcaatggcaacatctggatttattttaaaggcagagactcttgccccttttaatccaacttcctcttggacagttcccactgcatagacctgacagtcaatatcttcttcagataaccttttcataacttctaagagaacagcacatcccaccctatcatcaaatgcctttccagttaatctatttttacctaaatcataaacctcacttaaaaaagaaacccatgttcctatattaacccccatttctatagcctcttccctactctcagctccaatgtctataaacatatcttcatatttaattattttggttttttcttcttctttcattctgtgtggaggttttgagcctaaaacaccaattaaatcccctttacttccatgaacaacaaccttttggtttaatattgttgggtcataaatgcctccaatctttgtgaattttaagaaaccattatcgtcaatatatttaaccatcaaaccaatctcatccatgtgagctgctatcataatcttctttcctttattccctctctttgctattaaattcccaaagttatcaatttcaacggaatcacagtatttttccaactcttttttcataaactctctaacactatcctccctcccagatattccatgtagttttgagagcttttttaagtattcaacaactgacataatctctcaccttttttaaatagtagttaatgtattcctaatccaactattttagatttatgttttaatggtaagtgtccaatttcctttcgtcaattttctcaatctttataagattaaattaacttattttctaaaatctcgacattccttttaaaaatctctttaatttcttcaccatcaaaaatttaccaaaatcttaacactccatctttgtaattatatacgactccagaaatgtctaaagcataccataataattctcaatcctatctctaaaaccaatgtgctgaactttgccataaatttttaattcataagttttagacatgggaattaccattttcataatgaggaaacctatagtttaaaatactaaattagaaaaatagaaaataaaagccctatggtgtcttcatggttaatgaacataaagcacatgcctcatttatgtttaagattattaatgtatttgtaagttttggttttaatttgattttagggatactcatctatgacatattttttaacattgatgaaaatttagttgtagcatgcatattgatagccatgccaataatagccttccttattctcattttaactggaggagttcataaggaacttacttatctacaaatttatgacaagtataaacttatgtgtgagtttattagagaaattaccatatcaacaatcaccagtgagttggcaactattgcaacaatgatactctaccaactacaaaatccaataaaaacaataacatttttgttattactcatagcatttttggcatttggactaatattcacaaaattactaattgacgcttactttataacattaaaaaagctaaaatccctaaaagaataatattatgatgcctccttatctaatttgtgcaagttataataaacaatagccacaactccagccataaaaacaagtattgctataactccaataattaatggattaatctccataagcatcaactccccttcttatctaattagagtataaagatataattaagtataaaactttttttctacataacttatgtttatctctcttagcttattaatcttttgaagatttaaaaaatcttgtttcagattctctaattccctctttaattccagattttactgcactcttaataaactcataacttaaccataaaacgaatattgtaaaaagaatcaatccaataactatcatggtgagaatatccataaagtcctcaccattatgttgctaatttcaattaaaattagcattaaaatataataaaaatctttctaaaattattattctgcatacaaaaaagcttatatcctaatagttacataaataaaaaattatttgacgagtataatattggtgattaattatgataacaacttatgagctgataatatatggtagagtccagcatgttggatttagagataggattgaacatataggtagaggcttaggcatctctggagttgtgtataatcataaggacggaactgttagaatcttagcaaactttgatgatgaggagattaaagagctatttaaaaagagtattaaggcactggaaaagaaggataagcttataaagattgagaagattgaggaaaaagaattaaatgcttatattgagtttccggaagggataagtaggttgtcttctgatgatattttggagctgaataaaaagctggatgagggagttaagtatattaagttgatattttctgaattagaagaacataaaaaaatattgttagatattaaggatacacagataaaaactattaaagtgctaaatgaaattaaggaattattggagaaaaaactctaagattatttttatagagttagagtaacatactgaaattttagaaagaattaataaaaaattagataaattagatgatatttatgaaattctaaaagggattaaggacaaactttaaagcttttttattgaggcgaaattttttattgtaaaatgtcaaaagaataaaagatttacaattaagagattttttgactttttgagcatatacaaaagtctatttatggtgaagtcatgaacctactgttaatgggaggaactaaggatagtgttgaaattggtaaaaagcttagggatttgggagatttatttattttatacacttcaacaactgattatggtggaaaattaggggaggaatttgccaacaaagtgataacaaaacctttagataaaaatgagttgaaagaggttataaagaaatataatatagatattttagtcgatgccactcatccatttgcaataaatgcaagcaaaaatgccattgaagtttgtaaagagcttaatataaagtatgtaagatttgagagaaaagaggaaaagataaatcatccaaatataatatatgttaaagattttgaagaagctgcaagattggctaaaaaagcaaataaagtctttcacatggcaggaattaagaatttaaagatggttgttgatattgttgggaaagataaggttatagcaagagttctccctatatctgtaagtgaggcattaaagattttacctcaaaagcagattgtagctatgtatgggactttttctaaggagcttaacaaatatttaataagggattataactgtgatgtgataataactaaagatagtggggagagtgggggttttaaagagaaagtttatggggctttagaagctgaagccaaggttatagttgttgaaagacctaaaattgattatccagtttgttttgatgatatagatgagcttataaaatacatagctaatttaaaaatttaattttataattttggtgaaaaggatgcactgcaatataaacttaaaatatggcgttataatgaaaaaagattgttatacattaagaatctcattaaaacccggatttataaatgctgagcagttaaaggcaatagcctatgttattgaaaattttggagataacaaagcccatataacaacaaggcaaggtatagagtttaaaatatctccagaacatttggaagaagtagagaaaattctaaataatgtggggttaaacttaggttctactggaaatagagttaggcaagtagtgtcatgtattggcttagagtgctacaatgctattggtgactctgtctctttggcaaggagaattcatgaggagtttgaaggagtttgggttccaagaaaggtgaagataaatgttagtggttgcccaaattcatgcacatttcataggttttgtgatattgggatatgttatagatacaaaataaccataaacaaagagatttgcacaaattgtggaaaatgtaaagatttttgtgatttaaatgctatagattgggaacgaaaaataataaaagataattgcactggagaaggaaaatgcactggcttatgtaatgcctttaaagctgagagagttattagcatattcgttggaggaaaaggaggaagaatatataaggagggaaaacacctaatagatttaaaaaatgaggatgatgtcttatttgttattgatgaattgataagcttatatgcaaagtttggaaagggtaggatggcagattttgttgaaaactatgggattgaaaacttaagaaataacataaaagagttgataaaatgaaccaaattattaatgataattatagggaattcttaaaaaaattaagagagagacatttaaaaaagagaaaagttaaagataaaaataaacctattgctgtgtggatgcaagatgatatatatagagatttcagcataggaaagtcccttacaataattttaaggacagaaggctgttattatgcaaaagaaggaggctgtttaatgtgttcctatttaatggactcctctcctgaaaaaataactgctgaaaatataataaatcagtttaattatgcgattgagaaatataaagaaaaaataaaagatttaaaagatttcagcgttaaaatattcacttctggaagttttttggatgatagagaagttcctaaagaggcaagaaattatattttcaaaaaacttagcgaatttgataatttaaaagaagtggctattgaatcaagacctgaatttattgatgaagacaaattaaacgaaattagaaaatatttggatgttaatgttgaaattggggttggaatagaaagttttaatgaagaaattagagaaaaagcaattaacaaaggaataacaaatgaacaaataattagagctatagaattggctaaaaactacaacattgggataaaagcttatttattaataaaacctctattcataactgaaaaagaggcaatttatgactcaatatcttcagcaaataagtgtatagagttgggatgttcaagaatatccttttgcccagctactgtgcataaaggtagtgtgatggaattctttttcaacaaaaatcaataccgccctccatttctatggagtataattgagatactaaaagaggttaaaaaaagcaatccaaaggcattaattatgtgtgatacatcaggagtaggaagtgaaagaggggctcacaacctttataactgcaagtgcaacaaattgattaaagaaaggttagagagattcactttgacacaggatataaatgttttaaatgttgaatgtgaatgtaaaaatatatggaatgcatatatcgaagttgaaaataaaaatatagttccattaggggatgaaagaaaactcctattataaaaatttattctggaatctgtcctcctggaaccataacacttaacttaacttgtttaactccttttaaggctgttaatctatctgttaattccctaatcctcttagcgtctcctctaaccaatattgtttctaagcagtggtcgtggtctaagtgtaaatgtaaggtagcaacgataatatcagtataattgtgttgaatttcagtaattttttccataacatctgaggcatgatggttgtaaattacgcttatacttccagctctttccccttctaagctgtgaatccatttgtgttttattatatagtctctaatagcatctcttattgcttcacttctacttgcatatcctctttcagcaataatttcatcaaactccctaagaagctttgaaggtaaagatatacttatcctatccatctctgtcataatctcccccgtttattttcaaactaacaaatattactatttaataactaatatataagattaacgataataataatactaactaatattattagtctaaggggtgagagagtgagtttaattatttgctactatggtaaaaatggggctgtaattggaggagatagaaggcaaatattttttagaggtagtgaggagaatagaaagattttagaagaaaaactatacagtggggagataaaatctgaagaggaactttataaattggcagaaaagcttaacattaaaattataattgaagatgatagggaaaaagttagaaagatatctgattcagtagtatgtggagaagttaggagcttaggaattgatgcaaagagaaggagggtttatgcaacaaaagggaaatgtgccattgttgatatattaaacgacacagttacaaatcaaacaataaaagaaggttttggaattgtagttcttggaaacagattcttaaaaaagaaagctgaggaggaattaaaaagaacagctaaattattcccaatgatgcctatacaacagatagaagatgcaataaaagaaatttttgagaaattaaagtggcatcctacagtgagtaaagagtatgacatttacagtgtgaataaatatgaaaagaactttgaggaagttattaaaaaggatattgagagcctatttaaatatagggaacagttgaggaaacaactcatagattttggaaaggttatgagtatagtcaataaaattgtaaaaaatggagaaattggagttattaaagatggaaaacttcacttatatgatgattatatagctatcgataagatagacccaaatccaaaggtatttaaagttgtggatgtggaaggcaactttaaagatggtgatatagtagttattgaaaatggagatatgaaaataaaagggactaatgagaaagtaacaaccaaatatatcataattcataaataacatagtcctaaagttcaataagcaaatgttgttagataaccttattcaattaattaatgatgtaatgtttttgaagataagcgtgtcctaatattaaaccgaagagtatatatttaacttaactataactttagtgttgtaaataggtaatataaagattttagaatggtgacattaatggcaatagctatcgcgatagcatctggaaaaggaggtactggaaagacaacgatatctgcaaatcttgctgtggctcttgcaaaatttggaaaaaaagtggctgttttggacgctgatatagcaatggcaaacttagagcttatcatggggttagaaggaaagccagtaaccttaaacgatgtgttggctggtaaagcagatataaaggacgcaatttatgaaggtcctgaaggagttttagttattccagcaggtgtttcattagaaaagttcagaagagctaaaccagaaaaacttgaggaagttttaaaggcaatacatgatttagttgagattttaattattgactgtccagcaggtattggaaaagagactttaatagcaatatcatcagcagatggtttaattgtcgttgtaaatccagagatatcctcaatatcagatgcattaaaaattatcgctataacaaaaagattgggaactgacatcattggggctattgttaatagggtttcaaatgagagtacagagttgggggttaaagctatagagacaattttagaagttcctgttataggtgttgttccagaggaccctcatgttaggaaggcagctgcatttggaacacctctcgttattatgtatccagattctccagccgctcaagcaatcatggagatagcagctaagttaattggagctaaatatgaagcacaacttaagaagaagaaagaatcattcatatctaagtttattaaaggattgttcgggaggagataaggatgattttgtatataattgtggctattagcatactcctcaacataatactggggattaaagtaataatgttacaaaaagaattggaggaggttaaaaaagctacaagattaacaaaggaggaggtcgaaaaattaaatgaaagaataagaaaactaaaacttggtgggtaagatgaaaaaagtaattattcctctcttaatatccttatttatttttttaattccaaattatgctttaaatccagaaattatagttacccccgaaaaatgtttagtaaataattccgtatatgttatatttcaatggagagctccttataatgttgaagattttaatgttacagtcctttcagatgctgtagtgtttaaaaattccactttatactatgcaggtgttgcagaggatgctaaggtatttcacatatttgaaggtgaggctgtaactcctggaaatcatacaattaatgttcaaatgtcgtatattattgatggaacgcttataaagaaaaaatttttattaaacatctcaatattaacacttcctgaaaatatttatgtaagttataataatacatataatagagatgaagaaaacacatctctcttagaaaatattactaaaatatttgaaaataccacaaatgtaactacaccaaattctacaaatgcaattattaatgaaacaaatatcacccaaaataaaacaaatatatcaaaaaatattgatatagggaatattacaaaggcaaacactacatctcaagaaaaaataacacaaaaattcaataacacatcaacacaaactattgaaaacgtccaaaaagataaaggtaataattggctgatgtatgggattcttgggttgattataggtatagtatttgggtttgttgtaatgtatatcatcaaaatctaaaactaaaaacaccaattcctatttttctactttttcttattaccataaaattttaaaattttgttaaaaatttactagcatccaatttatattgtgattacctatgattgcaataattccagcattcaatgaggaaaaaaatattttaaaggtgttaaaggacttagaaaagttaagagttgatgctgtagtagtggatgatggttctaaagacaatacctcaaaaatcgttgaagagtttgcaaaaaaagcaaagattaatgtatatttaataagaaatgaaaaaaatgaaggaaaggcaaaagcaatagagaaaggaacaaaatttgccttatctttaaacaaatataaatatatcatatatattgatggagattatcagcacaaaccaatggacattccaaaactgttaaaaaaattggaagatacaaatgctgatgccgtttttggtattaggaaatacaaacatattccattgcataggcaaatatctaatttttttgcttcaatacttacgtcgttggcagtgttaatatactcaaaaagattttatttctttagggatgttcagtgtggttttaggataataaaggcagagtttttaaaagatatgaagtttggagatggttatgcagttgaacattttattgctctgcagttagcgaaaaaaggggctaagattgtggaggaatatgtgagtgttgagtatcatgatgaagctgtttcatatataaccacaaagaaaatcttagaagttgctaagcaggttataaagttcatttttttagagtagcaaaataacagtaagctttaaatattaagttaaaaatattagcatcacaataaattttatatattgggaattgaaaacacacatagtccttctctttatctataaaacgaaacagccaaaataggtgatgatatggcttctttaagaccaaacagatgttacagagatgtagataaaccaccatacacaagaaaggagtatgttaaaggggttccacaaccaaaagtagttcatttcataatgggtaacttatcagcagaattcccagttaaggttaatttagtagctacaagaccaatccaaataagacataacgcattagaagctgcaagagttgccgcaaacaaatatttaacaaagatgtgcggtagaatgggttacaaattccaaattagagtttatccacaccaaatattgagagagcacaagatggctactggagctggggcagatagaatttcagatggaatgagattggcatttggaaaaccaattggaacagctgcaagagttaaggaaggacaggcaatcttaacagtatgggtaaacccagacaaattcccagctgcaaaggaagctttaagaagagctgcaatgaaattaccagttccatgtagaatagttattgagcaaggaaaagaattgcttaaattataattatgaaactttttttaattttttataacattttcacttgtaataactctactattttatttataatattatcattcaaatatttaaatttattttaaaataaaagctatatataatcccctatatattgttaattatccaaaatacaaaaggggatagcatgaaatttattgcatggttagacgagttatcaaataaagatgtagacattgctggaggtaagggagcttcattaggagagatgtggaacgctggattgccagttccaccagcattcgttgttactgctgatgcttacaggcactttataaaagaaactggattaatggataaaataagagaaattttaagcggtttggacgttaatgacacagatgcattaacaaatgcatcaaaaaaaattagaaaattaattgaagaagcagagatgccggaagatttgagattggctattattgaggcatataacaaattatgtgaaatgtgcggagaggatgaggtaacagtggcagttagaagttctgcaaccgctgaagatttacctgaggcaagttttgcaggacagcaagatacttacttgaatataaaaggagctgaaaatgtagttaaatatgtgcaaaaatgcttctcatctttatttactccaagagccattttctacagagaacaacaggggtttgaccactttaaggttgctttagctgcagttgttcaaaaattggttaatgctgaaaaggcaggagttatgtttacagttaatccaattagcgaaaattatgatgagttagttatcgaagcagcgtggggattaggagagggagttgttagtggttctgtctctccagatacatacattgtcaataaaaagaccttagagattgttgataagcatatagcaagaaaagaaacgatgtttgttaaggatgaaaaaggagaaacaaaggttgttgaagtccctgatgatatgaaggaaaagcaagttttatcagatgatgaaattaaagaattggctaaaatagggttgaatatagaaaaacactatggaaaaccgatggatgttgaatgggcttatgagaaaggcaagttttacatgcttcaagcaagaccgataactaccttaaagaaaggtaaaaaagagaaaaaggcaaaagaagaggatatcgaggcaaaaatattattaaaaggtattggggcatctccaggcattgcaacaggtgttgttaaaataatccacgatgttagtgaaatagacaaggttaaagaaggggatatattagtaacagagatgaccacaccagatatggttccagcgatgaaaaaggcagctgctattgtaacagatgagggaggattaacctgtatagaaggagatgcaaaaattttaacagataggggctttttaaaaatgaaagaggtctataaattagttaaaaatggagaaaaattgaaggttttgggattaaatgctgaaaccttaaaaacagaatggaaagagataattgatgcacaaaaaagagaggcaaggagatatgaaattggcgtttatagaaagaataaaaatacaaaagatacaataaaaatcactccagaccacaaattcccagtgtttgtaaatggagaactcagtaaggttcaattatgtgatattatagataacaacctttctgtattgagtattgactacatcccaatgattgaggagaagtatgaaagcttagcagaagttatgtatttaggaggagcagttctttcagatggacacattgtcagaagaaatggaaaaccaataagggtaagatttacccaaaaagacactgaggaaaagaaggacttcatagaaaaagttaaaggagatgttaagttaattggaggcaactttatagagattagcaatagaaacaacgttattgaatatcaaacaagtagaaaaataccttctgaaatattgggctttattgaggtcaatataaacactatcccattatatgctaccaaagatgaaatagccgatttaattgctggatttgttgatggagatggatgtttaagtggaaagagaagagttgagatatatcaaaactcctcccatatcaaaaagattgagggcttaattgttgggctatatagattgggaataattccaagattgagatataaaaggtcatcaacagcaacaatatactttaataacaacttagaaactatactgcaaagaacaagaagaatcaaattagataagctaaaagagttcaaaaaaccagttgaagataaaaaattaatagatatatctcaaatactgccagaacttaaagaatttgattataagggctatttatacaagacatataaagaaaaactattcattggaataaataaattagaagaataccttagcaaaatagataaagatggcattgaaagaataaaacaaaaaatcaaactcttaaaagagagtgatatttactccatcaggattaaaaaagttggagaagattatggggaagtttataacataacagttaaagcagaaaatgagtttaaccacaactatgttgtttggactaagcattacactccaatagttgtattcaactgccacgcggcaatcgtttcaagggagttaggaacaccttgcgttgttggaacaaagaaagcaacgaaggttttaaaagatggaatgatcgttacagttgatggagagaagggaattgtttatgaaggagagattaaaaaggttgaagaaaaagagaaaaaacaggaggttgttgttcaacaagctccaataataacagctactgaggttaaagttaatgtcagcatgccagaggttgctgaaagagcagcagcaacaggagcagatggggttggcttgttgagagctgagcatatgatattaggattaggtaagcatccaagaaagattttagaggaagagggagaagaagcattgatagaggcgttaatggaaggaattagaaaggtagcagatgcattctacccaagacctgtaacttatagaacattagatgctccaacagatgagtttagaggtttagaaggaggagagaatgagccaatagaacacaatccaatgcttggttggagaggaattaggagagatcttgatgaagtagatatattaaaatgtgaattaaaggcaattaaaagattgagagaagagggctataagaatatagagatcatgatccctctcgtaactcatccagatgaagttagaagagttaaagagataatgagagaagttggtttagaaccatgtaaggatattccatttggaattatggttgaaacaccagcagcagctttaattattgaggactttataaaagaaggaataaactttgttagcttaggaactaacgatttaacacaatacacaatagcaattgatagaaataacgagttagtttcaaagtattataaagaagatcacccagctgtgttaaagttggttgagcacgtaattaaaacttgcaaaaaacatggcataaaaacatcaatttgtgggcaggctggaagcagacctcacatagttgagaagttagttgagtggggaattgatagtgtttcagcaaacattgatgctgtagagacaataagaagagttgtagcaagaactgagcagaaggttatattaaactacataagaaaatcatatgtagagagggagtaattacctttaacttttaagttttgtttttatgactattttatcattatatattttaacaattccaaatcttcactatttttggtgatacattgagagggtttataattggtaggtttcagccattccataagggacatttagaagtaataaaaaagatagctgaggaggttgatgaaataattattggaataggtagtgctcaaaaaagtcataccttagaaaatccattcacagctggtgagagaatcttaatgataacacaatcgcttaaagattatgatttaacctattatccaatccctataaaagatattgagttcaactctatctgggtttcttatgttgaatctttaacccctccatttgatattgtgtatagtggaaacccattagttagagttttgtttgaggagaggggatatgaggtaaaaaggccagagatgtttaataggaaagaatattcaggaactgaaattaggagaaggatgttaaatggagagaaatgggagcatttggttcctaaagcagttgttgatgttattaaagaaataaaaggtgttgaacggcttagaaaattagctcagacagacaaataaaaaataaaaatagtgatattatggaggaaatcattgatgtaaaaaatccaaaagaagttattgaataccttaacaatatagatgttgatgagtatgttgagatatattttggaagggttcatgttgaaggtaggttaatgcattataacgatggacttataaggttggttcatgaaaaatatggaattatagaggttgaaattgagaaaatattggatgatttgttagagttagttcatagtaatggagagaaaagagttgtgttgaggttttattagtcaatcatcaaaaatagataacattttctaaggttattggtatagaagcccttttgagcttctataagtttattatataactataaaaacttttgatgattgactataattcagcttttttgtctaaaactaagttatttatatcattttggtagttaatattttaacaaattattatgtaacctaaagaaatttggattttttgatttttatattttaaataatatagacaataaaatagaagaaacaaaaattttgagggaaattatgcattgggctgatgtaattgctgaaaaattgattgaagagagaaaagcagataaatatatcgttgcgagtggaataacaccttcaggacatatccacgtaggaaatgcaagggaaacactgacagcagatgcaatctataagggattaataaataaaggagttgaagcagagttaatttttatagcagatacctacgacccattaaggaagttatatccattcttaccaaaagagtttgagcagtatattgggatgcctttaagcgagataccatgtccagagggttgctgtgaaagttatgctgaacactttttaagaccttacttagagagtttagatgatttaggagtagagctaacaacatatagagctgatgaaaactacaaaaaaggactttatgatgaaaagataaagattgccttagacaatagagaaaaaattatggagattttgaataaatttagagctaatcctttaccagatgactggtggccaataaacatagtttgtgaaaactgtggaaagttaaagacaaaggttataaaatatgatagtgagaaagaggaaataacctatagatgtgagatttgtggatttgaaaacactgtaaaaccatataaaggaagagctaagcttccatggagagtagattggccggcgagatggagtatatttaatgtaactattgagccaatgggtaaagaccatgcagcagcagggggaagttacgatacaggagttttaattgcaaaagagatttataactatataccaccaaaaaaggttgtttatgaatggattcaattaaaagttggggataaagcaattcctatgagttcttcaaaaggtgttgtgtttgctgtaaaggattggactaatatagcccacccagagattttaagattcttattgttgagaagtaagccaacaaagcatatagactttgatttgaagaaaattcctgacttagtggatgaatatgatagattagaggatttctactttaacaacaaagataaagatgagttaagtgaagaagaacaagaaaagataagaatttatgagttatcaacaccaaaaatccctgaaactaagccgtttgttataccatatagattctgttcaatcattgctcagctaacttatgatgaagagaaggaagatattaatatggagagagtatttgaaatattaagaagaaataactatagtatagatgatattgatgagttcagcatgaaaaaattgaaagatagattgttaatggcaagaaactgggctttgaagtatggagaaaagttggttataattagtgaggatgaggcaaaagagatatatgaaaaattgaaggataaacaaaaagaatggattaaatacttcgctgaaaaattaaaaacagcagagtttgatgctttaaacttgcatgagttgatttatcaaacagcaaaagaacttggcttaaatccaagagatgccttccaagcatcgtatatgatactcttaggtaaaaagtacgggccaaagttaggagctttcttagcaactcttggaaaagattttgttataagaagatattcattatttgaataattttttactttttttggtggtaagatgataaaaatacacgcattagaggaagttaaaggaaattctaaagaaattgttgaaaaagaatttgaaaatttggctaatgagctgaaagaaaaatataatgctaaacttaaatatgtagatgaagacatagaagaagacgaaaatttaaagttttatacaaaaattggagaatttgagataaattttgataactttaaggattatataaacttctgtttaaaatatggggcagatattgaagttataaaaccagagaaattaaaactcacagctaatgagataaatgaagttttagctttggttataagtgcgtttaaatcatttatggatacatataagattggatttgatgtatatgttaaagagaaaaaagatatagatgttgagggatataaaaaaggcaagtatgatgaagatgaaatagccgattttgaagaagaagggtttataagagttaaggcagtgtttgaagctattggaaaaaatgaaaatgaagtggtaaaaaacctgcttatttctttggatagggatgagattataatcaacaagattataactaaaaacttcaatgaaaataatgagaattttaatggactaatggctgttgatttgttatgtaatccctttgagatgtttgaaatcgcctataagtatttaccagttgctatatccatccaaagagatgagattgaattaagtttagctgatattcaagatattggtaacgagctatctggagctatgttcgaacttagccatgccgtaattatgaggaaatagctatgctaagaggcattaccgagcgtagcgaggtaatgcatctgttttgatcaacgcaccatagcttcgccctattgggatacctatttaactaagttttgatcaaccttttctaaaaggttgttcgagtaaccttttactaaaaggttgggagcaatgtttgagcttagccatgcggtagttatgaggagatgagttcgtttgattaaaatagggcttaactctatctctatttggggtatccattataaattaaaaattatttgaggtggtaaattgcatccagctttaaaatacatgaggcaagatagattgccacacatcttctgttctggatgtggaaatggaattgttatgaattgctttttaaaggctattgaagagctaaatataaagccagaggactatatagctgtttcaggtataggttgttcttcaagagttcctggttatttatactgtgattccttacacacaacccacggaagacctatagcgtttgcaacaggaattaaaatagcaagaccagataaacatgttgttgtatttactggggacggagatttggcagctataggtggaaatcacttcatccatggatgcagaagaaacatagatttaactgtcatctgtataaacaataatatctatggaatgactggggggcaagtttcaccaacaacaccttatggtaaaaaggcaacaacagcaccttatggtagtatagaaaatactatggatttgtgtaaaatggcgattgcggcaggagctacttatgtagcaagatggacaacagctcatccaattcagcttgttaggtcaattaagaagggtattcaaaagaaaggatttgcgtttattgaggttgtctctcaatgtccaacatactatggaagattcaacatctcaagaaagccagctgatatgattaaattcttaaaagagaactcaatacacttaaataaagctaaggatatgagtgaagaggagttgaatggaaaaattgttgttggtgagtttttagatatagagaaaccagagtttgttgaggaattgcataagttgattgagaagttaaagagtgaataaaaggagggttaagatgagaaaagagataagactctctggatttggtgggcagggaattattttggctggagttattttagggagggcagcagcattgtatgacaataaagaggcagttcaaacacagtcttatgggccggaagcaagagggggggcaagtaagtcagaggttgttatcagtgatgagccaattgacttcccaaaggttataaagccggatatattggtttgtttatcacagcaggcttatgataagtataaggatgatattaaagagggaggagttgtattggttgatgaggatttagtttcaacagataaaatgccagaagttgatgtaacgatgtataaaatcccatttacaaggattgcatcagaggagataaaacttccaattgttgcaaatatagttatgttaggagctttaacaagattaacaaatattgtttcaaaggaaagtatggaaaaggcaattttagatagtgttccaaagggaactgaagagaaaaacttattggcatttagtaagggatatgaagttgcaaaggagttataaagaagaggcattgcttctgtaaagaagcaatgcatccaggtatcccaatagggcgaagccctatggttagtaagggttatgaagttgctggaaaattgtaagtatctgaatatttgattttatggactacaaatagaaaattattattttaataaaaaactttctaatttttgagatttttttaatttaaagggattttatgaaagattttattatggagataattttatagaatcaaataatcggagttataaaaataatctttaaaattgagtaaaactaataaaaacttttgaaattttagataattaaaaaatagatttctatagttttggttttatatgttttatttgtatatgaaaaattgataaaaatttatccaatgattacattatcagattttgattttaaagatttttaaatgaaaattttaaattttattagttaaaaattctctatttggttgaaataatcattatcactaaaaaagtattactcaaaatttagatttgaatgaataggggagattttttagatgtaagatatgatttttaggttattatttgattagaggttttttgttaatttattagataaaataaaaggtttttattgaatgttaatattggttattaataattttaaatagtaaagtataaatattagttataatatatctaaatataaagggtttaagaagaacattgttgtatggaaactaaacgtttatcgataatatcggttacatctgatagtctgtttaagaagaacattgttgtatggaaacgggaggtgtgagggcggctcccccctaatctctaaaattgtttaaggagaacagtattgtatggaaacccatcatagtcacctcctctctttttccacgatttttgtccaaccctatatttcgtgtttaagaagaacaatattgtatcaaaaactcttttttatccactctaaaatatcctaaataattttttatatcccaaaagagaaatattaaactaaaaacctattttttggtgtccattatgccaaaaattttatacaatccagaggttttagggcataaaccaaaatcctaccatgttgaaaatccagagagagttttaaccattttaaacagcttaaaatctaatggctttgatgatatagttttaattgaaggaaaatctacaattaatgagattttagagattcatagtagagattatgtatattcaattataaatctaagcaaatcatttaactattatgatggtgatacatatctctgtgatagaaccttagacgcagcattaactgcctttaaattggcaaaagaagctgtaaaattagcattaaaagatagggatttatactttgcattaacaagacctccaggacatcatgctggaatttctggaagggctttaggagcaatgtcaaacggtttttgcatatttaataatatagcaggagctgcaagattagctaaaaattatatgaaaaaagtcataataattgattttgatgtgcatcatggaaacggcactcaagaaatcttctggaatgataatagagttattcatatagatttccaccaaagaggcatctatccaggaactggagatatattagatattggaggagaagaggcaaaagggactaaaataaatcttcctttcccagcacattcaactgatgctgattatatatttgcatggaatgagattgttgagccaattttaaattactttagtccagatactgttttagtttctgcaggttttgatgcatttataaatgatggccttgcaagtatggacttaactgaaacattttatagatttgtaggagctaagctaagcggatatagtgttacagcagttttagaaggaggatacagtataggtttaaagtatgctccaccagcatttttagatggatatgttgatgctaaagatgtgttggataatttagaggattatacagttattaattctaatgaagttaaatcaatggttaaaaatgttaaaaagataattggggagtatttggatattttttaataggactccgcagtttatatattataataagtagttagacgttaatttttgctaactttctaccaaactctttaatttttttaatatcattttcttttggagcaaatctaaatgtcaatatcttatcatcaacaattttaaaccctaaccttttaaaagcctcaattatttttttagtcgcacattctttccaaccataggagccaaassstacgccaatctttttattacttggctttaatccttctatataagttaataacattccaacctttggatgcacattcatatttattgttggagaaccaaccaatacgtattttgcgtctaagatatctctcattataatgttcaatggggaagtatctaatctgtggtatattacatcaactccttcttcagataatccctctccaagggctttggctattttttctgttgaagagtatatagttgcatatacaatgactgcagtatttttatatgaatcagaacaccacatacggtattttgttaaaatttcatcaatcattatatgccaaataacaccatgtgatggacatatatactctaaatccaaatccttcaagatatttagaatttttaagatgctttttctatatggtaataaaatattggcaaaatactccttagcatccagcataattttatgaccaatatcactgtctattttctctttataaaccacatgttgactaaataaatcatttgaaaacagaattttatcttctacacagtatgttagcatatattcacacttgtcatcagttataaattttaatgttctatttccaatatttaattcatctccattttttacaatgacaaattcccaatcttttgtattaaattgagcatctaaataatattttctaatttttgtagtcacaatcttcgcttctgtaagctcaataagtttttctatgcattcgttatggtcaggactaatatggtttgagataatataatctaatttcaaattagctacgtctttcaaatatgacaataattcatcaaaatactttattcttgtagtatcgattataacattgtttttatctaagattagatatgagttatatgtagtccctttttcaatgtctaatcccctatactctttaattttccattctataaaactcatgcagtaaatattatcttttattttaagcaccatatatttcaccacaaaaatattaattataagaacccaaaactctaaagattacaacattaaatattctggcgatagtaatatataataaatgtccaatgttaatttaagtaaaataacaactaagtaatctttataaatgttttagtttgattaacagcatagattgagggaaattatggtaaaaatagactacaaaaagtgtggttattgtggagcgtgcgttggagtttgtgaaaagttagctatcaatttgatagaacatattatagttattgatgaaaaaaagtgtaataactgtaagttatgcacaatagtatgtccattaaatgcattagagggggaatgatgagagagttaaatgatgtatatgatgtagtggttgttggagcaggtcccggaggaagtatggcaagttatgcatcagcaaagaatggagctaaaacactattaattgagaaatctcaagagattggtgagccagttaggtgtgctgaggcaattccatcaatagaggaatttggattaaaaccagaaccagagtttgttagaaacattattaagggaggaattttattttctccttctggaaaaaaagttacagtaactcaagataaggctcaaggatatgtagttgagagaaaaatttttgataaatatttggctataagggcagctaaagcaggagctaaagtagcagtaaaaacaacagctattggtttagagagggacggagattattggaatgttatagttgaatttttaggagaggagtatgttataaaaactaaagtggttatagctgctgatggtgttgagagcaatatagctgaatatgctggtttaaaggcaaagaaaaagccattggagatttgctcctgtgctgaatatgagatgacaaatgttgaattgttggataaaaatatgatggaattctattttggtaatgaagtggctccaggagggtatgtttggatattccccaaaggagaaacagctaatgttggtttgggagttagagataaaaagaagaaggcaatagaatatttagaagagttcatagaaaatggtttagctaaagataggttaaaggatgcaacaccaatagaattcaaagttggaggagctcctgtttctggccctatagaaaaaacctatactgatggtcttttagttgtgggggatgctgctgggcagataagcccattaactggtggaggaatttatttagctatggattgtggattaatagctggagaagtagcaagtaaagctataaaattaaatgattggagtgaagaaaccctaaaagaatatgaaagaagatggaaagaaaagcattatgaatatttaatgagccatttaaagtatagaaaaatcttagagaaaatgagtgatgatgagttagatgctttagcagaagctttaggagaaagtttagacggcattgacttgaaaaaatttgtcaagagaataataactaaaaaaccatcacttttaaaatactttaaggatttattataattttattctttctttggttttttaactactaaaactggacagtgtgcatttttaataactctctcagctacacttcccaataatattctttccaatcctgtctttccagtagttcccataactatcaaatctgcctttttcttttcagcaaattcaacaatctcatttgctgggacaccctctaacatctctgtatgaatcttaactccccactcttcagccatttttttaactttttttaatgcttcctgcccctcctcttttaaaagctcacttatcagttcccaacttccctctgcaggaagtccaacaaatggagagacatcgacaacatatattgcataaacttctgcatcaaactccttagctatattgattgcatgctttgcagcttcaagtgaaacatctgaaccatcagttgggatgactatttttttatacaagttttcaccatttcttattattgaatttagtatataatatttaagtgccaataaaataaaaacctttttcattagtgattatcaacatgataatacacatataaaccctattaactcctaataaaaatcattaattttgaaaatatatataaatatggcaatgatgaaaagagggttagctgaactgtgatgatacttacccgaactgagccattattttttattctttttctttctctttatctttatctaagtccataattacaatgccttcttttagtttttcaacttcttcctcacttaatatctcttcttcaacaccttctccaataatggcactatgtcctaatgggtctatcagtattaaagttgcttcttctttaccctcttttaatttctttattctttctctaagctcttcagctttctttttctgttcctctgtctcagcccatctaattaaagtctgtaaaatgttatcaactctgtttaaaaccccctcaacattgctaacaaacccttcagctaatggaccaggcttaatttcaactccaagttctggaatttgtatatatgctgaagaacttctaacaactcttttatttaaatccctctcactttcaatttttaatatatatttcttcggctcccttacttctaatggaaacacgtcacttcttctaaagttgcatttttcacaaatcatcgttgtttctaacacagggccgaagtatgggatatctatttggtgagaggttattacaaaagtgcctttacctccacatactggacagtctaacctttgcacattttccattttatcacctatgggaacttttaatcaatctaatatataaacttttcgtcttattttttgtgggtaacttttatatatttcccagaggataatgttattccatggcgataatataatgattgattatgaaaaatggcggaatatgttttcctaatttatttggtagatatcaaatatcaatttcgtgagaacatgtataaaaaattagagattattgaaagggcaatactattaaatcctcaatatatccaggcttttagagaaaaattaaaaattacccaatcaaaattagctaaagaaagtggaattagtcaatctcatctcagcatgttagagaaaggaaaaagaccagcaactaaacttatagcaactgctgtaactcttggtttattaaaatgtttctcctcaaacaatgttgaaaatccaataattgaacttttagatgcactctcccttttaaagtttgaagatacttttgcagaatttgtatctgaaattattgaaaaaggtgataaggggtatcttaggttaattgaaaactaccctgtattaataataagtaaggagaacttattaaatgagatgagaagtaggttagaagttatggatattgagaggatagaactatcaagagggagaataaaagtcataggaaaacatcttgacaataaatatgttgagatattcttagattgctcagatattaggagattagaaaaaaaattcatgaaaaaaactgggaagaaggttatcatccaagtatttccaaaagatgaagttccaccaatttattcaataaataaagattgtgttataattcattgctggtaaatcagggaaataaaagaaagtggggctgaacgtagtgaagccccgctctgggtatcccaatagggcgaagccctatggtgtataataattcattgctggtgagagtgatggatattattattttatatctaatagctctaataacatcagtaattgttgctttagtcctaaaacttccaataatcccaaaagaaaagcctataaggtttagctttgagacatctattatatttccaacaccaatcttagctttaggcattgaggcaatatttaggaatttatttggggattatataagcttggcattctttgctgggctgtttggagctctattatcaaaatatgctgataagttatttggtgagccgtaatggagattgttgaaattgtaaaaataattattgctgggattatctgctggcttaactttgttcttatcgatacttattttggacttccagaaaagccaggagttttaggagctaagacaataggagagaagattagagatatcggtggaaatttaaatggaggctactttatgggaaatattgtgtgctctccagatgcctcagcaggaacattattggcttcaataatgaactacctaatgggaattgaaggagggtttatagcggctttattggtttggattggtaatcgtctatgtgcagacccaggttatgctggaactattggagctttaacaataactgctattatctatctcctaaatccaataattgaagcaaaatatttcattgtgggaatggtcttggcaatatttacaattcaaggatttgagcacagatatgcctctatattacttggaaaaatagctaaaaagatgaatagaggggaatgatggatattgtagagataattattggatttatagcattgttaatgacagcaaggatattcttagaaagaagtagagcaagaaaattgctttacctttgttgtttaagcttctgtatctctgcattaattgctctatatgtggattcaccaatgggaggtatagtggctataacatactttatatgctcaactatctcatccaatgcaattgcctatacaatagagcaaacaaaacatattgaataggtgaaaatttggaggttttaccattagtatctggaatatgttgcatattgggaggaattggagttatcttacatacaaatccaataaacaaaattattatgcttgctttgttagaaatagggatgattggtttaattgtttcatgttattacctggatattgctatagtctcatcactctgcgaaccaatctgcacagtaattttattacttggatatttgaaatacctaacaacagtaaagaaaaagaaaagatatggtagaaatttgccaatattgtctaaataagaaaaagtatggtgaatatttatggaactcgttgaatatattctctatattggatatgcactattaattattggaactcttggaactgttatagggccgaagttgataatcccctaattaggatgttaaatgttgaagtaccaacaataggcgtttctttaatattcttagcttatgatgaagcccttgcattgatgacatttattgcagttaatgcagttttgagtttaattttgattagagcagtgatattagatgccgaatataaagaaaataatcaataaagggggaaataatgaaaaaacttggaaaccatagagggaaaccctctattgggatacaccctaacacctcctcgcttacgctcggaggtgtaaattaattttgattaatttgtttggaaaaatttgaggtgggtaataatgaaaaaacttggtaaaatatggaactatttatcaaagccagaaattgtcccaagaatattctctgtattcttagctttagtctttatatttgggttattgatgcctcattacttaaatcccaatcaactttatccaaaaccaattcctcactctcaaacactaaaaacaccattagcaccttatgatagaggagggattccattaaaagaacctgcagagttaaaagctcaatatccacaatatgaacctaatcttggaaagataactgcctatctaactccaatagctgaatggattaaagataaaacctactactttgggacaacaatagtctcaacacctggaggaatattggatgaaatcctatactatacaagaggaatggatacagtgcttgaaagttctatactgctaatatcgttcataatatttagctggttattcttcaacaaggattaggtgggagagatggagaacatcatctacagtatataccatccaacgatattggttggatttgctattggaattttgtcattattggctattggatttcaaaagaatgatttacatgctttaatattgactgatgttgttgagtgtgccatgcttataattatagcaggtgttggaacagatttagctgaagcgttaattttgccaggtttagttgttagtttagctgaacttttagcagtttcagaggttttaataacaagaaaatatctaaaatcaaaaagacctaagccaaaaagctacaagttgtttgaagagtttaaacttccactatatacaggagaattgaagtatgatattcatatggaaattttaaaaacctcaccaaaatttttggcaataattttaattgtttatggagctatattgagtggatttactggaggggcggttatagctactggattgctgttttatgcactatctcagagagttattggcgtggagatttcagaggaattaaaaacaatgtgggagggaatatctggattatctggaattgcatgggctttgtggatatttggatttataggtttctttgtgttcccagataaatggttactgtgtctattgatggctggtttaggtttagttataaaggttggctcaaaacttggacttattggatatataggtgaggtaagatgattgacaaagcataggaggagacctcctattgctataccacccgtccattaagttagggctttcagccctaattaatgtccattatttaataaaattaggtgagataaaatgattgaatcaataactggctatctatttggaattgttccatttggagacattgtatttggcttttcagaattttcaattattggatttatcactgcagtaatatttaccatcatagtttatttaacaaagccagaaaagcagttagaagctcaaaaatttaaaattgaagataaattagaggtagtaacactaaatgagttaaaaattaggagaatgatggctattgtctgcggaatagcaactgctggagctatgctaacttatgatttgtttgattatgccttattcttaactttagttgggattgcaaatataggtattgtctcagcagttaaaagagaatgggtgttaaatgcaagttatcagtatggacttatagcgatgattgccacccttccattatttggttctgcagggatgatattggctaaaacagggacattatcaatctttgaactgccaaaaatacaaacatccctattatttgaaaaaattatatttgccgctggaatggctggagaaactgggatagctcccttctatgctgcaaaggcggagatgtttagagctcctggctcaccatacatattgatgatacacctctcctcactgttgttgattgtaaggactgttgagattctattgacaatttaaaatactttaggtgaaaaacatggatgaagagagaaaatatggattatattcattgattattggtttgttgtgtgttattgggattgttatgcttaatgggttgatttgctatgtcctatatattattgcagttccttctctcctatatggaattggagcatttataattccaaaaacaagaagaaaagatgctggaaaattgccatttagaggatattgaaaatattaaaataaaaatctgggtgaggatatggatacttcactgatagggactataaacgaaacttttagaaaaagttgaacgaaaactcttagagttttcatagctggaaagcatagctctccatttcatcaaaaactaacacctcctcgcttcgctcggaagtgtaaatttacaactgataaaatctgggtgatgcttatggatacttcacttatcggagctataaacttaacaatccatgcatttcttgttggttctctgttacttggattacatagaaaaataatggcaaggattcaaggaagaccaggacctccaataatccaatatctattgcatacactaaaattctatgtaaaggaaataactttcccaataactgctggaaatcctctctatatatttgtagctttattggatattgctatttggttagctgcattaattatagctattgatttcaagtcatccctccttataattataggaatctatgtattgcaaaaaatagtggagcatggttgtggtttgtcatctgggtctccttatggaaagataggaggggttagaagtgtcttttcagcagctgcagaagtgccattatttgcagttgttgctgccatatacttaacaacacattcagttttaatttcagatatattgagttatcaagaaatacacggcagtttattgtttaaaatgccaatttgtgcattcgcattctttatattgcttgtttcaaaagctccaaacagtccatttgggatagttaagggtaaagatattgttagcggatatatgacagagcattatggtttattaggggctataatctacattgcagaggcaatagcatactttgtattgctctggctctttatagctgtatttattggtcctttagtaataaacagccctgtattaacattggctgtaatggttgtaatgacagtgattttagcatttgttaatggattaacaccattattagctcctcatcattcagtcatgcttcaaatgacaattgctggacttgtattgtgtgatgtcctatatcgattaatagtgggtggataaaatgaaaagctacattgtatccataggggaaaccccctattgggatgaaccttttagtaaaagcttcaccaaaacctaacacctcctcgcttacgctcggaggtgtaaattagtaagatttggggagtatcccaatagaggggcgaagcccctctatgggtcttatacagactaacagtgggtggataaaatgaaaagctacatttatttctttacaattgcatgcattattgccgtgatttattgtgtattggttaatctattgcaaataaatgtcattccagtagttttagcatttagcttaatcttgatattaacaatctcaaccataaacaaaaaaatagcccataaaatggaagatattgaggttttatttatgctcttagttttagctttctttgcatatgcaatttataaactctacattcctgtgtaaatggtgaaatcatgggattatttgagctaaatttggctataatattgtttatcattggaaactttattggattggaatatagctatagaaaatactcctctccttatgtagaaaaaggtattgataagtttgccttagctatttcagtatttggggggattttaattaattctccgttgtatatgcttggatgtctattaattggatttcctttaggtatgagacctggatatggaagagttgaatttgttgttggattagcagttgccctgtttctttatttcttgaggtggtaattatgactgagattgttgatattgacaaaaaatatgttgagaattcattaaaacagaagatgaatgttcttaaggataatagatttttaatggatgatgtatttattccaatagctaaagctttaaagatagaggttgaggaagttattgaaatatttgcaaaaaaattggattttgcatcttgttatgaactccatgcttatgcagagcaggcaaagatgggctgtttaggaaggaaggtagatattgatttagggctgtgctggcttagtgatttctttggacttataaaaaaagaagaagcagatttaattagaaaaaaggtagttgaaagttatttgctgtataaaaagccatataaagaggcgttggaggaaggtaggcagatgattatcaaattgttaaaggaggaatagccatgatgaaagaattattcagaaaccatagggcttcgccctattgggatacccaggatgcattgcttctgcaaagaagcaatgcctcttaaaatttattgggaggaatagccatgatgaaagaattattcagaaaaaggtcaatacatgtttgtgttgtcaatactgggggttgtaatggatgcgatattgagatagttgcctgcttagctccaagatacgatattgagcagtatgggatttacgtccataataacccaagagaagcggatgttttattagttacagggccagtaactttacaatgggcagagagattaaaggagatttatgaaaaaacaccagaaccaaagatagttgttgctgttggagcttgtgcattgagtggagggatttttaaggaaggacatgttgttggaggagttgataaagttattcctgtagatgcaaaaatccctggatgtcctccaagaccttctgagattattgaaacaatcttaaaggtagctcctaaggcaatagcaatgagagaaaagagattaaaaaataaagatgagtgaaaatatggcaacaattcctataggaccaattcatccagtattgaaagagccgttaaggattaaacttgttttagatggagagaaacctgttgatgctgaaattgaaatgggttatgttcatagaggaatagaaaaaattatggaaggaaaacattgccataaaggaattcacttagcagaaagagtttgtggtatctgttcctatgtgcatacgatgacgtttgctgaatgcattgagcatatatcaaagatagagattccagacaaggcaaaatatcttagggtagttacttgtgaattagagagaatacacagccatttaattgcttcagcagtgtataatttatctattgaacatgaaacacttgctatgtggcttttgaatgttagggaaataattatggatttaatggagatgattactggaaatagggttaatatgggttataatgtaattgggggagttagaagagacataaatagagagatgatggatgagatatataaaaaactcgatatctttgaagatgaactaaaaaatattattgaggtttttgaaacagggcctttaatagctttaagaagtaaagaaattggtattttgccatatcatgaagttatgaggacgagggctgttgggccaatttgtagaggttctggattgccagaaagtgattggaggttaagacattcaacatatcaagagttgaaatttaagccagtgtggagggaggaaggagataactttgcaaggatgatggttaggcatgaagagattattgagagcgttagattaattagagaggctttagagcattatgaagagtgttctggagatataagggttaaggcagagattaaaggaggaaaaggagagtggaggaatgaagctccaagaggagaggtaacttataggatggaaataactgatggagggataataaagaggataatgattagaactcctacagttatgaacttggaggcgtataaatatatgctaaagacttgtccaactgtagctgatgctgtatctgcttatacaagtatcgacccttgcgtttcatgcacagagagatgcatagttgcagtaaaggatggcaaggagattccaattagtattaaatttaggtgattgttatggcatcttcgctatggtatctttatgaatttgcaagaaaaaagtggattaaaagatttattgatgcaaaatcagataaaagctcctatattcctccagaaagatatagaaaaatacctccaattgttaaatttcctgagaaatgtatatcctgtgaaggttgtaaggaaagttgtccagcctttgcaattgaaatgatatacaacgaagagtataacaaaaaacttccagtgattgatgaaggttcttgtgtagcatgtgccaactgtattgaagtttgtccaacaggagttttagagatggataagcatagggttgagacagagggcttattttttgataaacctaaatatagcaatcttataattgacgaggaagtctgtgttagatgtggaaattgcgaaagagcttgcccaatcaatgtaattgagcgtaaagaagggaaatatgtaataaatatggctttatgtatttcttgtaaagaatgtatcaaagtttgtcctatagagaatgcaatagttgttgttgatgaaaaaacattgaaagagaagatagataaagcctttgaaattaaaaataaaaaaattactgggaagttggaaattaaggagaacgttattgaaaaaattccacatattgttagtggcttgtgtgtaagttgtggaatatgtaaagatgtatgcgtaggagagattgatttaaatgaaaaaaaggttgttgagtgcgtaaagtgtggtttatgtatagaagtttgttcaactactgcaataaggatttataaaccaattataccaaagaggaaggatatttgctacgttattgatgaggatttgtgtattggctgtagaatttgtcagaaagtgtgtgggtcaggggctattaaaattagcaaagagacaaaactaccatatattgttccagagttgtgtgttagaggaggagcatgcgcaagagaatgtcctgttggagctataaaagttgttaagccagaagaggcagaagaggcggttaaagttagaataatagaggataagataattgagagcattgagaaggatttagtcttatacactgagaagtatggaaaggttaaagaagagattgaaaagttatccctcaaaaagttgaaagaagagctaaaaaggagagtttatgaagaaaataaaagaataatggaaaaaaagagggagctgtatgataaaggaaataatagctaaacatttcaatttagctgataaaaatatccaattactcccaaaatttaatattattttaaataaaagagagattatcgttaaagaggataaatgcattagctgtggaaaatgtattgaaatctgcccagtgaatgcaataacctacagtagtgatgggttatatataactattaataaagaaaaatgtgtgttttgtggaaaatgcaaaaaagtttgtccaacaaatgcaattgtaataataagattgagatgcgaaattaacgaagatgcaaggattattgaagtagataagtatgaatttattgattatataagtgagagatgtgcatcttgcttagtttgtttaaggaattgcccatttaatgctattgaagaatatggaagtaaaataaggattgatataaataagtgtgagctttgtggaaagtgtgaagaaatttgcccgttaaatgctataatattacgataagaaatactatttcataaaaagtcataatagtttgcattgaaaggtgattacattgattgagataaaaaagtcattggatgagatattatcaaagatagatggggataaaaagtatattaatgaggtagccaaaaaaataactcccataacttataaattgttatatatcaacgaaactaaatgtattagatgcaatctttgctacaaagaatgcccagtagatgcaattgaaaaagcgaaggttaaaaaatctgcaaagataattgaagataaatgtgttaaatgtgaaatttgtgcccaaacatgccctgttggagcaatatatgttatagagggaagggcagagattgaagatagcgaagttcattatacaataaaagaaaaatcaatccctcacagaaagattaggttaaaaaaatatgagcttgatgaaaatacttgcataaaatgcggaatttgtgcaagattctgtccaacaaatgctataaaggcagttagaagaaagagcattgaggttaatttagatttatgtatgggttgtggtgcttgtgctgaggtctgcccaaaaaaatgtataaaggttgagagagagcttggagaggtaataaaaaccagagacattgaagttgataaaaatctatgtgttggatgtttagtttgtattgaagaatgtcctatcaacgcaattgatcaagatggagataaagttaagattaataaggataagtgcatattgtgtggaagatgtgtagatgtatgtccaactaatgccataaagatgtgggaaaagaaataatataatacaagaataaatctttaaaggaaattaatgtcttttaggcatctaaattccaaagttgatatataaactgcagaagtcccaataataaatttatttttaagctatttttgatgaatctattgagatttctgtttttatattaagtattgatttttttttagcatcaagttggtttaaccgaaaagtatatatatgggcatatataaagatttgtatagtcatatagtcacataaattattattaccaattattacaggtgatgattatggtaaaatatgggataaaaattgaggatgatagagtagagattgtgagatactcaaccgtctatactgatgaaggtgttgaggagttagaggaaatctatttgcaaattaaggctgatgattatgaaagcatattgggtatatatgaaccatatccaaaaaaagatgtaaggtttgttggaaatttagatgatttgaaggttgttaaagggcaagaaatgagaactgcagttccaattccattgtctctgtgtagagccaagtatttgaaaagaattgacgaagatgatgaaagaataacttacttggatattaatggagtccctattcagagagggataatagttggaattgttgtaggtgttcaacataaaagaacatctacgggtaaagattacaccatatttagaatatttgatggatacggatggggaagattgagactgtttggaattaaagcaaatccagaaatatttacggggatgtttatcagaggatttgtgagatttggagctgttgaatttagaactgaggaaggagaattaaggaaagcaatatctttaacgctaaatgatatacctgtaattgttcaacctaaggaatacattgtccataaaaagtttatagatgaggttgtattgccaagagttgctcctgaattgatagaagaggataaagaagaggaagagactgatgaagaaacaataaatagttaaattatcaataaattgattttttaggtgatattttatggtattgggaaaaataaaaccaccatagggggaaaccctctattgggacacaccctaacacctccgccttatggcggaggtgtaaattcaatccaattaataatcaggtgatatttatggtattaggaaagataaaatcactactaccaaattctcaaattttaacaaaagttaaaattgtagatatcagaaggaaggagagtgaagaaggttcaatattttacattggaactatggttgataaagatggagtagccaattttataacaacaattcctttagagagaggaaaatgttacgagatatttggtagaataacagaagaaaagagcgttagaatagttgaaaaagttattaaaggtgtaaaatatccaagagaaattccagaaattcctaaagaacaactatacaatagaggagaagttttagatgtgaaagttccagccatattggaggtttcacaatcaacaatatttgtaaattattactgtaaaatatgtagaggaattgttgatactaagattaaaccaagaggtttagtttatatttgcagaaattgtggagaaatagacccagaagatgtagatgtaaaaattaaggtgtttggaaagatacactttggaacatcttcaaaaagatgctacatcccgccagcaacattagagcaatttatgccaggaattttagatatgcttgaagagtatggaattgacgatacaattagagaaatctgcttaaaattaaatggaaaaacattcttagttagaggatttgaaggaaaggaaggaaattatataataactgaaatggaagacatttaactcccataggaggaaaccttctattgggatacttcacgtccatttaaccaattatcaaagtttttaattaaataaggcactatagaagccctttgggcttctaaattccatagtaaataatattttctttgataattggttataagttggggctttcagccccaattaatgtccaagcaagatttgggggagtatcccaatagasggggctacgccccctctatggttatatataattgaaatggaagatatttaaatcttttttatatttcatcaaatttttatacttgttgtatctattttttatcataattaaatacaattacaaagggagagtatgctatgtataaaaaagccttctgtagcctcagcttttaatgaattaattcccaaaatattgaaagatggcgaagtagttgagacagagtttgaagagaggactaaagaaattagaaatacgattatagaaattacaaatccaaaattaaaaaaagttccagaaaaatatccgttgggagagaaagctgtggaagaatacacaaaaaatcttttatatggctctaaaaatgttttcagctatgattatcatcagaggttgtttgaatatccttatgctgatgaaaaaattaaccaaatagattatattattgaaaaattaaatcaacaaaaaaatagtaggagagctgtagcaattacttggaatccaaaaattgatattgaggttagtagggatgaaagaggaagcgtcccttgtttgcaacttgttcaattcttaattagaaatgggaaactgtatcaaactgttatcttcagaagcaatgacgcactactggctttcgtaagtaatgcgataggtctgataacgttgggagagtatatagcaaaaaaggttggcgttggttatggtacttatactcatcatgctatttcaatgcatatttatgttgaccgggattttgactatattaaaaaatacttccctgaatgtttgaaatatttgtggtgattgaaaatgggtgttaggaaaaaggtaagtgacagaatgattaatgaatttatcagattatatttagacgagaagtgatctatttcggaaatagcaaattattttggattacatcatgagacagtaagatatcatttgaaaaaaaagaaatatagtcctgagacagtataacgaaagtagggttattagaaacggactaaaactaaatcttgaaccttctgaaagtttagcatatatcttagagtaatagaaggagatggatgtgttactaaaaataaaaacagtagacatcactatattaatctgaatgcaatagataaagattttgtcgatgagtttgaacgtcatcttagaaatataggccttacaaaaattcaaaggtctactattaagtatgataatggagggagaaaaaactaatatgttgttagagcatactcaaaatacttctacgattggtactggaatttggacaaatatgaaggttacataaaaatgttcaaaagtaatcatgattatatagcaatgtttttgaaagggatgttcgacagtgaaggatgcgtcgaaataattatatagtaaataataatagtaaaagaggaaattcaaaaagtgcatttatccatatttccaatactaacgagaaactaatagatttgtgttttaaatttttagaaagtttagatatacaatatagattagaattcaggaaacgaaaaaacgaaaatcaaagggatgtttggaaaatatttataaaaccacatagttttaacgatttcagagaaaaattggaacttcaataaaaagaaaatacgacaaaatgtatattgtatgtaatatgaaaaagagtgaactacttaacagacaaagaaaggaatgaaataataaaattgtataacgaaggttataacattaatcaaataaggaaaaggattggcagagattttaatacagtaaaaagatgtttacaaaaagaaggtattattaaagtaccacactaattaatttaggagaattgtggctgaaaagacaaatactcaattaagaagttatgtgcatcattctgttagcatgcatatttacattgatagggtgataaaatatgtattatatttatattgtgtctgttgataattttgggcagttgggtttttaatttttgttattatggtttgtggtttgtctcgttgaatgattaaaatcagacccattcgaaatgaaatatctttttttctttttgtatattccactcaatatctactatattaaaatcagcgatttgggatgaaaactttatcaaagcacacttttcaagaaatcttatttagatagataccaaaatcagactctaagggaatgaaactcaacttctgaagcttttttgtttatttagcatatagagataaaattagcttcatagaaaataaaactattttagccagttgaatttactatataaagtcagaatagaattattttcctataatcttataaaatctacggattttgagactttattctactatttaattctcattttcactcaaccgaaaattttatatatggtttctgatatcttagcaatataaaatttttcaaaatttcctgaaatttgctattaaagatttataaaatagcctcatcttttttaagtaaaatatttatatcagataccatataatatggatgctttttgttaaatataaaaaagaaaggaggatgactatggacagagaagcactgttgcaagcggtgaaggaggctcgcgaactcgcgaagccgagaaacttcacacagtcatttgaattcatagcaaccctcaaagagattgacatgaggaagccagagaacagaataaaaacagaagtagtgcttcctcatggaagagggaaagaagctaaaatagcagttattggaactggagatttagctaaacaggcagaagaattaggattaactgttattagaaaagaagaaattgaagaattaggtaaaaacaaaagaaaattaagaaaaatagctaaagcccatgacttctttatagcacaggcagatttaatgccattaattggtagatatatgggggttatattagggccaagaggaaagatgccaaaaccagttccagctaacgcaaacataaaaccattagttgaaagattaaagaaaacagttgttataaacacaagagataagccatacttccaagtgttagttggaaatgaaaaaatgacagatgagcagatagttgataacatagaggcagttttaaacgttgttgctaagaagtatgaaaaaggtctctaccacataaaagatgcttatgtcaagctaaccatgggtcctgctgtaaaggttaagaaagagaaggctaagaaaaaataaataataataagtgaaggggatagaaatggaaacaaaagtgaaagcacacgtagccccatggaaaattgaagaagttaaaacactcaaggggcttattaaaagtaagcctgtagtggctattgtagatatgatggacgttcctgcccctcaattgcaagagattagagataaaatcagggacaaagttaaattaagaatgtcaagaaacaccttaattataagagctttaaaagaagctgctgaagaattaaacaatccaaaattagctgagttagcaaactacgttgagagaggggcggctatattagttacagacatgaacccattcaagttatacaaattattagaagagaacaaaagtcctgctcctgtaagaggaggacaaatagctccttgtgacattaaagttgagaaaggttcaactggaatgcctccaggacctttcttaggagagcttaaaagtgttggtattccagctgcgatagaaaaaggtaaaattgcaattaaagaagataaagttgttgttaaaaaaggagaagttgtttcaccaaaattggcagctgtcttagacagattaggaatcaagccaataaaagttggtttaaatatcttagctgtttatgaagatggaattatctacacaccagatgtcttaaaggttgatgaagagaagttattagctgacatacaagctgcataccaaaacgcatttaacttggcatttaacacagcatatccagcaaaagaagtattgccattcttaatacagaaggcattcataaacgcaagagctttatcagtagagacagcattcgtaacaaaagaaacagctggagacatattagcgaaagctcaggctcaggcattagctttagcttcaaaattgcctgacgaagcattggatgaagacattaaagctaagttgtcctcagtagaagtttcagctgctccagcagctgaggaagagaaagaagaagagaaaaaagaggaagagaagaaagaagaagatacaggagcggctggattagccctattgttctaaccgaaaaatataaataactaattataaatagtgaattgcaaactctacttcaaattaatattgtttagatattacggttaaaacaaataaataaaacacaaaggagaacatttggaggtgtaaattatggaatacatatatgcagctttattattgcacagtgcaggaaaagaaatcacagaagatgcaattaaggcagttttatcagctgctggtgtagaagttgatgatgcaagagttaaagcattagttgctggattggaaggagtagatattgaagaagctattgcaaacgctgcaatgcctgttgcagctgctccagctgctgcagctccagcagctgctgctgaagagaagaaagaagaagagaaaaaagaagagaagaaggaagaagatacagctgcagttgctggattggcagctttattcggataaattttctactttctttttttatttttaaatattacatttattaagttaaatatacaaattttatgtaatatttaaaagtatttatatataaagtatttatatatggggtttttatataatatctaagttagttgttaaataggtgaaaatcatggaaccagaaattaagattgttaatgttgtagtctcaacaaaaattggagacaatattgatttagaagaggttgctatgattttagaaaatgctgaatatgagccagaacaattcccagggttagtttgtagattatcagtgccaaaagttgctttattaatatttagaagtggaaaggtaaattgtactggagctaagagcaaagaagaggcagaaatagccattaaaaagattataaaagagttaaaagatgccggaattgatgttattgaaaaccctgaaattaaaatccaaaatatggtcgcaacagctgatttaggaattgagccaaatttagatgacattgccttaatggttgaaggaactgaatatgagccagaacaattcccagggttagtttataggttggatgacccgaaggttgttgttttaatatttggtagtggtaaggtcgttattactggtttaaagagtgaggaagatgccaaaagagctctaaagaagattttagatacaataaaagaagttcaagaactctaaattttagggatgaaaatgattggaataattgattacaacgcagggaatttgagaagtattcaaaaggcagttgaactctatgataaggtaataataacaaacaacagtgaggagttattggcttgtgataagataattctaccaggtgtaggaaattttggtagtgcaatggaaaatttagctccattaaaagagacaatatacaaaattgttgatgatagagttccattcttaggaatatgtttaggaatgcagattttatttgaagagagcgaagagaaaagaggaatcaaaggtttagggataataaaaggcaatgtaatcaagtttaaggatgttgaaaaacttccacatatgggctggaatagtgtaaaaatagttaaagattgcccactgtttgaaggaataaaaaacaatagttacttttactttgttcattcatatcatgtaaatccagatgaagattgtatagttggaaaaactgaatatggaagagagtttccaagcgttataaacaaagataatgtctttgccacccaattccacccagaaaaaagtggaaaaattggtttaaagattatagaaaattttgttgagttgttataattaattttttgacgtttcatttaagaaataatctaaaaactctaatccactgccataattaactgcctttggatgaattgagagaaaaaactttctattttcttttatacttaatttataatcagttgttgctattttttcagccacttttactaatggttttggaagataccaagtatattctctgtttgtaatactaatttcaactattttcccatctttttctgttatcattttattttcaaggattattgtaatatttctccctaaaaacagtttttcagcatcttctgacaatttatatcttggtggaataaaatattttatttttttaggattaaaaccacattcctctaaaattttaaatgatttatttaatttttcctctgccacagttttgttacagttgaactcatcatctatatgattataggcgtggaactctatatggtaaccttctttttctaatttatggagataatctacaaattcaggataattttttaaattatatttatttgcatgattgacaattaaaaaaagatagctcctattttgataatgatatttatctataatttttactatttcctttagttctttaaaatacactggtgagacatcatgaattaaaattattggtttttgttcatcatcatcctgatgacttttactactgttgtcaaaaaaagcaaatgttaagaaaaatactgcaaatacaacaagaaataacaaatatttaaatttattcatcatcttctttcactttctttttaattcttggcatgcataaaatctctcttgcctctatgttgaagaaagtattcatattagctggctttataaccatcgctgtatctgcccctctacctgttcctccaatggctataacctcttctttagcctttatcaaaccagcatcacatgccataattgtgatttcatagcaaaccttaactccctgtccaaatgttcttaatgtctcagcaataacttgaacaggaccataaccacctaatttatttgaaattcctctctcaactccacttaatgcatgactgcctctaaataccttagctcctcttttctttagctcttcctcaacctctttatccattgatattgtatcctctccatggaatccttgatgatatgtaactacaacaacatttaaatctaatccctctttctccaacaaatcaagcaattttttagcagtgtatccagtagatgaagctacaactatacttttaatatctcccttcttagccctctcaacagctatttttaatgtctcatctgtattttgaattcctggatagtcaaagagtttcattattccttccctccatgataattttatttgttaatttttatttctcttccttaaaacttcttcaacaatctccttaaagacttcatcagttataaatttaccttcctctctaatctctttaacctttttaacaatctcgcacaacatctctctatcgtaatcaattcccataagttttagcttataggcaacggctctgcatccagaatgcttccctaacaaaatatttctcttaagccctattttctctggaaggaagggttcataggttaatggattctctatgacagcatcaacgtgaattccactttcatgagcaaatacaagctctccaactattggtttgttctttggcatctttattccagagtattcctcaaccattctgcataactctggaagaacctccaagtttaatcccaaatcaacatcatacaagacagttaaagccataattagctcttctaaagctgcattccctgccctctctccaataccattaactgttgttgaaactgccttagctcctccaattaaaccatatattgaatttataactgcaaatccaaagtcgttgtgacaatgcactccaatatgtgccttttttaagttctccttcaatgttttacatataaactccatactttggggggtagcacagccagttgtgtctgctatatgaaccctatctgctccagcctcttcagcggctttatgcactttaatcaagtcctctattggtgttcttgtcgcatcctctgcagagaaagcaacaaataagccatgttcctttgcatactcaactgcctcaactcccatctctaatatttcatctaagcttttgttgttgaatttatattttaagtggagaggagatgttgctatgaaggtaataatcccatctacatcgcactctattgctttatctatatctttctttaaagccctgcataaagctaagatatcagcatttagcccttcattagcaattgttttaactatatctgcttctctttcagatactattgggaagccagcttcaatctgctttaatccaagttcatccaacttccttgcaatctccaatttttgttctttggtaaagcaaactcctggggtttgctctccatctcttagggttgtgtcataaatataaatgtcctttaaatccaactttggattgtagggacaaactgctttccagctgttctcaaataagaaatccataaacatcaccagcacttttgtcatagagttgttattacctgtataaatttttttattattttttaatcaaaatatcaatatgaagagattgatttattcacttactttttattttacctctatattagcccctaagctcttcataacatcaacaaagtttgggaaagagattttaacggcctcctctccttcaataattgtttctccttctgcctttaaaccagctatagtaaatgccataaccaatctatggtcgtgataggtgtttagcttagccccctttagctttttaactcctcttataattaaaccatctggtttctcttcaatatcagcacccatcttttttaattcaacagcacaagctcttaatctatcgcactcctttaatctaacatgttctccattgtaaatctcagtctttccttctgcaaagcatccaagaactgcaattgttgggactaaatctggaatatctttaacatcaacatctattccttttaagctgtattctccttcaataattactttatcttttttaactttaatatctgctcccatctctttgacaatattgattatagctttatctccttgctttgagttggcaaataggttttcaatagttatatttgagtttattaaaactccagcagctattaagtatgaagctgaagaataatctccctcaacaatataatctattggtttatacttctgatttccatagactaaaaagccgttatcagttttatcaatctttattccaaatttatttaatatatccaatgttatatcaatatatggctttgattttagtggtgaggttagaattatctcagtatcttctttattaaatggaaggagcatcatcaaagaggttataaactgagagctaatgtctcctctaatctttaccacatttccataaattttcccacttttaactattattggtgcagttccatctaattttgatgaaaatgcctctatatttagctgttttaaggcatctaataaaggttgcatcggtctctttcttatagaatcatctccagttaaaattgcatatccttttggtatctgtgaggctatagaggttaaaatccttaaggttgttccactgttcccaatatctatgatattatctggggtttttaactctcctcctttaacaatccattcatctttttctttatctaactcaatattagcccccaacattctacaaccatgaacagatgataaacaatcagctccccaaagtgggtttattattctgctaactccatcagctaaagatgctccaataactgctctatgagtgtaagattttgaaggaggagctttaactatcccttccaatctatctgtttttttaacaatcagcaaatacatcaccactaattttttaatcaacagagtataatttaaatgtgatatattaaggttgttataattacacagttaatacaaatgaaattatgataattctatatacccgattcttaattcttgtctctaatgagaaaaattaacatttataaattaagtaagtgtgaaaattatggaaatctttgaatttaaaggtaatggcgtaaaaaagctgtttattggaggtttgcatggaaatgagggaaaatttacagaaattattcttaaagattttgtcaattcattaaaagaatgcaattatattggtgatatagtagttatcccaaaacttgttgaaaatagcaaatacatctctacattatcagaaaagtattatgaaagtgatgaaggtaaaacattaatcaacatcatcaaaaagtataagccaaaggtctattttgaactccatgcatataaaaaagaaaattataaaaaattaacaagcaacaataggaaaaaagttcctccactcatagatatcggaaacaatgttctaatagcctcaatctctccaattttaagaaagagatttagtaaagaagatttttgcatgaccattgagattccaagctggaaagtatatgaagtcaaagatgagattctaaagattttaaaaattggggctgaaagtttaagaagggaggagattattgaaaaactaaagaagatttatccagagcatatagagaaagcagaatatttttcaaagaaatataatttaatgctgttttgatgatgttaattctttataatgaataaaatcttaaatgtaattaaaattttaaaattaataatcgccaaatatctgaagtgagttttatgataatagaagagataaaagagagagctttaaatctgctaagtgagaaagaagaagattttaaagttattgatttctcctttgccttgccttatagctatgtattaattgaaagcaatggcaaaaaagctttgggagtggcaatgacgttattggaggaatatagagggcatggaaataggaaagatttaaatataaataaaaatttggaagagtttataaacatggcagatagttttgatattgttgaaagaactttgggagttgcagctatcaatgcagtatctcaatactattttaactttgaagctaatggaaaagatgccgctgagttagttttaaatagagacgatattaaaaaaatagctttcgttggaaatatgattccagttgttaatatgctgaaaaaatctgaaaaatttgatatctatgtgtttgagagaagtccttcactattgatggatggagttttaagcgatgcctttgaatataggttattgccagagatggatgccgtatttatcagcggaactactctgctaaatgatacattggattttgttttagatagggctaaaaatgccaagttaaagattttagtaggacctacagctcaatctttgccagagctatttaaaggatttggcataacacatatagcatcaacaaagattatagatgttgataaagctctcctatatttaaaatttgcctcttcttcaatgctattcaagggagcatcaaagaaatacactatggaggtagaataaaaatatatagtttttgcaaaagttattaaattgactaaggaaagttgaacaccttcttatagaaggcgttcattatataccttattattacaaaatgttttgcaaaaactataattcctctcagataccccgaaaggttcatcatattaagtcagctttttattgctcatcatcgaggaattaaaataatctctcagcccccgtaaggttcatcatcctaaattattattcatgaaagattttttataaacttttttatatcacttacactctaaaagtatagtgcctttcaaaacttattgagataataaaaggtattaatgaacgcctcctaaaggaaggcgttcaaagtttaataataagtttattaattttgaaaggcactatatatctacagttattcttataaagactaattaaatggtgagattatgggaatgacaattgtagagaagatattagcaaaggcgtctggaaagaaggaagttagtcctggagatatagtgatggcaaacattgatgtagcaatggttcatgatattacagggcctttaacagtcaatacattaaaggagtatggaattgaaaaagtttggaatccagaaaagatagttattttatttgaccaccaagttcctgctgatagtataaaagcggctgaaaaccatatattaatgagaaagttcgtaaaagaacagggtattaaatacttctacgatattagagagggagtttgtcaccaagttttaccagagaaaggacatgtagctccaggagaggtagttgttggagctgattcacacacatgcacacatggagcttttggtgcttttgctaccggtataggttcaactgacatggctcacgtatttgcaacaggtaaattgtggtttaaagttccagaaacaatatacttcaacattactggagatttacaaccttacgttacttcaaaggatgttattctaagcattataggagaagttggtgttgatggggctacatataaagcatgccagtttggtggagaaaccgttaaaaagatgtccatagcatcaagaatgacaatgacaaacatggctattgagatggggggaaaaacaggaattatagagccagatgagaaaaccatccaatatgtaaaagaggctatgaagaaacatggaactgagagaccatttgaggtaataaaaggagatgaagatgctgaatttgcagaggtttatgaaattgaggcagataaaatagagccagtatttgcatgcccacacaatgtagataatgttaaacaggcgagagaagtggctggaaagcctatagaccaggtgtttattggttcatgtacgaacggaagattggaagatttaagaatggctattaagattattgagaagcatggtggaattgctgatgatgttagggttgttgtaactccagcttcaagggaagagtatctaaaagcattaaaagagggaataattgagaaattcttaaagtatggatgtgttgttacaaatccttcatgctctgcttgtatgggttcattgtatggtgttttaggtcctggagaggtctgtgtctcaacctcaaacagaaacttcagaggaaggcagggttcattagaagcagagatttatttagcatcaccaataactgctgctgcatgtgctgttaaaggagaacttgttgacccaagggatttataatttttccataattctttttaaaacatttaaaaaaggcaggcactaatagtattctattttaaagctttaaacatttggggtttgcataaataacaatctttataaagtatagaaggcaaatttaaattaatattaaaattatggtgaaatgatgaaaaagacaaaggttattgttttagctgaaaatgccctaacaactccaggtaagttagtgagatatataaatacattaaatcagccagttattgtaaaagagacatgttttggagcatacattgagggagaggaagagttagtggataaattagctcaagaaattagaaattatgagagaaatagaatattttgtaaggacagaggatatgctatttgggataagaggagatgtagggcatttagaggaggaggaccaagagagggtttccaccaattagaggctgagcaagcggttttagacaaaattggtttagcattagataaaattgataaggaaggaataaaaccaatggaagaagttttagctaaagaaaatgagttgataaagagagaaactaaaatacctgtagaggagtttaaaaatattattgagaaagtattagggagcaaaaatgaggcataaatatagaaaaggaagttcatttgaaagagaattaaaaagacttttagaaaaggagggatttgctgtaattaggagtgcaggaagtaaaggagttgatttaatagctgggagaaaaggagaggttttaatatttgagtgtaagacttcttcaaaaaccaaattctatataaataaggaggacattgaaaaacttataagcttttctgaaatatttggaggaaaaccttatttagctataaagtttaatggagaaatgctatttataaatccttttcttttatcaactaatggcaaaaactatgttatcgatgaaaggataaaagctatagctattgatttttatgaagttataggtagaggaaaacagttaaaaatagatgatttaatctaactttagattttcgcttatgatttttgttataataacactcaacaatgcaatcttttttggtttcactacaactgatatatgtttgtcatccttatgaaagccaacaagaattgaagctaccctattttcatctgctggtaaaacccccactgaaactctcccatcaacaccaaaaactgttccaacatcatgtatattatgcactttaattttatcctttttaaagtccttgtttattttctcagctatcactgcactctgctccatcaagatttttaataaagcagctgattcaaaattcatttttatactatcctcaacatccttagatttcatttttaaaattagctgttttccatcacattctacacccaactttttatatggtagattcacaacatacacaactctcaccaagacagctaaaataatttatcggtaaaatttatttttgttgtgttgagtatataaaagatgcggttttaatacctatgaatttatccccattttcttactctttttaatacaactttttctcctccattaacttcctcatcaaactcagcaattaaagcccctttagttccaaacgtccccttaataactccccatatattcttatcagggatataaactttccccccaataagtttttctccagctgttttagaagatgctaatccctcaatatagattttatctttctttttaacaacctttccctcttttacaacaatctttttaacctctacttctccaaaatcaataacctccccaaatccacaaatccttaaagttgttggcggcaaatccaacctcattattaaaatcttatctccttcatcaacaacaactctttcctctaacttaaagatacagtagcaagaatctccccctttaatttcttccagtattattggttcctctttgtcattaatcttctctattttatatggaattattgtggctgggactgttaaaagcccaatgtttatatgaaccttcatctttggagctaagttatatttaaacaactcaagaatctttacttttgctataaacttatctactacctttaattttgtatcctctgaagttaatatgcaacctctaaataaactctctggttctacacccattaacgccattccaaccctatctcctgcataagctatagagacatcctgtttaaagcactgtatgcttttaaccttaacttcatgatttattggtaaaatcctaagattatctccaacctccacctttcccttatgaatcgttcctgttacaactgttccaaccccttttattttaaatgcatggtcaataggcatttttagatagctatttatatctctcttaatatctaagctgtctaacagatttttaagctctttttttaattcccctattccctctccagtttttgctgagattttaataatcttagagttttttaaatttattgttgagtttagtatttgtttcataaacatttcagttcttttaatctcttcatcatttgcaatgtctatcttatttataacaacaatcgtagggatgtttaataaatctaaaactaacagatgctctcctgtttgtgtctttggcccttctttggcatctacaactaataaagcggcatcaattatatttcctgccccaatagctgttcttatcaactcagaatgtccaggggcatcgactaaggtaatcctatatctatccaatgtgaaggaagagaatcccaaatcaatggttattcctctcttttgggattcttttggtttatctaaggcagaggttgaagctatttcagtcagttgctttgccagttgtgtttttccatggtcaatatgcccaaacaaaccaacatttacatttttcatttccatagaaatcaccaaattatttattaattatttatttttgttttttagctttcaacctttctcttctaattacaaaccatctctttggtttttttattcctaaaaattttatttttgcctttcttattgtcccggaaactcctaagcagataatatttactggcttttctttaaattccctaatcaaaattaaagaggcttttacataatcaacattatccctttgacatctcaaaataccataaggaaaatcataataaacaagccatggatttgccttggatgttccccaagagccataatattctaaaacagcttttctaattaaattaacaacctctccctcttttaactcctcatcgtataatattttaaatgcaatatatctctttttctcccttaaagttggtggtagtgttttaagcatttctatcactcaataaatagtgtgttgtatttagaaatttttatactacacatattttttaacaaaagtttttattatttaagttttattaaattaaaaaattaaaaacttaataatgggggatattcatgctcaaagattatgctcttaaaatactaaaaaaatctttggaatacgatgttggatttggagatataacaacaaactccatcattccagaaggtgtaaaggctaagggtgttattaaagctaaagaaaaatgtatagtttgtgggattgattttatcgttgcattttttgaagaatacggtataaaatgtaaaaaattatttaatgatggagaagaagcttatggaaacatattagagtttgaaggggatgcaagaaccattttaatgcttgaaagaaccgccttaaatctacttatgcacctctccggaatagccactatgacaaacagaatagttaaaaaagctaaatcagtaaataaaaacgtcagggtggcctgcacaagaaaaactcttcctttattatctccactacaaaaatatgcagtatatattggtggtggagacacacatagatttaggttagatgactgtgttttaattaaagataatcatatagcaattgttggtgtgaaagaagctataagaagggctaaggaaaatgttagctttacaaaaaagattgaagttgaggttagtaacttgaaagagttgagagaagctttagaggagagggcagatataataatgcttgacaacttcaaaccagaagagatagaggaagctttaaagataattgatgaatttgaaagaaaaaccaattttaagccaataattgaagttagcggtggaataaaagaagataatattttagaatatgcaaaatacaatgttgatgttatatcaatgggagctttaactcattctgtaaagagtgttgatatgagtttggatatagttaggtatcaataaaattaaaatttaatagaaagaataataaaataaaaatactaatatcacaaataataaactttataattctgtgatttatttggggtatatcacaattttttcattaaacaaaaaatatttttagggttatattatgaatttcgtaataataatagcaatattattgttaggaattagtctaatattggcgtttacggtattaaacaaaagtaaatctaaaactaccatggcttataaaagagcccaggaagaaaaaattgatactgaaattaaaatgttaaaaaatctaaaaaacaatgtgtgctctggagcttcagatgaaattatagataatattttaaatagtgaaaataatattctaaaagaagcccttaaaaataacttagacgatgcagatgtttgtaaaaaattaagaaggtaataaaacaccaacaacttcaacaaattttggattcttcatttttttatcaaaatacatacaaactcctaccattatatttctttttttagctataacatagtcgcactcacacccaatcatctcaaaactctctttcatcctttcaaaaccaaatgtatctggataaagaggattttcttttaaaatctcgtttattctactaacaaacttatctatctctttaatatcttctacaatctcaaaaccctccttttccaattttttaactaaataatctttaatactaccatatttctcaacttcttcatccctacaaactcctttaaccattaacatctcatccgtctcaaataacggcttagaacccttaaaagcatttaaagcatgcatcaatctaccaatattaactttccacatactaacaccaaaattataagtttttaacttcttcacagtattttttaatgatttcagcagattttctaaatgcaattatctcatctttatccaattcaattgatacaacctcttctatcccatctcttccaatctttactggaactccaatacacacatctctaattccatcaaactctccatctacgtaagcggataaagttagcaatcttttctcattattcacaatacacctaacaacatttaaaatggctgctgctggaccaaactcagaacctcctttcaatctaataatctgctctccttttgttttaacatcctctataatctcatctattggcagttccttaaatctttcaaatttttgaataggaattcctccgatagaggtagcacttaacaatggaaccatgctgtccccatgctctccaataattctcgtcctaacttcatcaatatgaacaccgaaaaacttagcaatagcaaccttaaacctcaaagaatctaaatgagtccctaatccaaaaacttgatttctttcaaattttgaatctaccagagctttataagtcatcacatccacagggtttgttataacaaatatttttgtatcgcagatttcagctatttttttagcatacttcccaacaatttttgcatttgtttttgccaaatccatcctactcattccctcttttcttggaacaccgcttgttattataacaacatcactttcatcaattatccttagattttcatcactctcaacgtatatatttgcatcacttcttgtcccagctaaggcatcgtagatgtcttctctcaatccttccaatttatttattgaatgttctcttccaattaacaccaaatccttcataaaaggttctttagctaataataaggctgttgcactcccaactctaccagaagctcctataattgtaactttcataatttcccctcacaaaagagattttaaaattaaattaaaaagaggaattaaagctcctcaacaaaagaatagatgagattaatgttatttgagagtatctcttcagcttcatctaatacatcgtttaatgtgcttattgtgatagcaggttgtgaaatctctgataaaaatttgtgaatatcattttcgtggaataaaattccttcataatatcttaagtttggaatagcatataaaactccgtccaaacttgttatctcccttgaagcatcaactattgtgtcaattgttaatgtcatagtcccagaggtttttgagactcttgcctttctataggtttttaaaacccctacctttgctttttcaatgaatggagctgttctcttatatgtattgtctgcctcataaatatcaacatcaaaaacccccttagggtcttcaacaataaaaacctttggattaaatttagctaaaaattcaggctcaattcctcccagtcctgttaaatcaacaattaaatcaggatttacttctcctcttataaattttagtttaaactcatttaaatttaagaattttatactgttgttgtttggaacaaatcctttcataaattcatgtatatcaactaaataaactttatcagcatattttgaaagcatttgggcagtgtaatttccccataaatagaccccaaatattacaacttctttaaactcctctccctctaagaaatccctaattgcttgatattttttctttgctatctcatttgtcacatcaacaactcttgtttttgtgtcaattgtttttaccatctcagttattccatacttcataattccacaccccaaaatgaaagattaaattaaatggaaattccaattctacttaatgcttcaattaactctttctttattctctcctctatatcttctttatgaataactgatgaaggtgataaagaggcagttaaaactctccctttctcatccaatattacaagcattgaaccagaacctggagctcccaatcttcccctcgcaatgtataaatcagctttttcaatatccaaagctattaatcctttagttaatgctggcattcttgttaaatcagcgaaccttgtatctatatcgagcatttttatctctgcattacaaacccttaacataatatctcttattactttaaatttcttttgattgtttgtagcaacaacaatctttttggcattgactatcttttcttgaattttttttagttcttcctctttatcccctctcctaatattattaattgattcaataaaagcttttttaataatttcctccattacaatcacttattttagtttatactctcttcaaccaatctaaatcattcttatgcaaatctctaatgtctgtcaatccatatctaagcattgctaatctactaaacccaataccccaagctaaaactggcttttcaataccaattggctctaaaacttctggtctaaatattcctgctcctaagatttctaaccagcctttaccctctaaataaacctctgcctctaaggatggctcagtgaatgggaagtaagctggcctaaatctaaccttttcaaagcccaatctatttaagaattcttttaaaactccaattaggttgttaaaattaacattatcatccattataattccttcacactgataaaactctggcaaatgtttataatcaattgcttcatttctaaatactctatctatacaaaataccttgtgaggcttgtttttttcttcatctgataaagatgcaaggtatcttattgatgatgcagtggtatgagttcttaaaatcaatcttcttgagacattttcatcaaatttgtatttccaacatctttcatgaacttctttaaccttacttaataaatcttctggaatatctccctcatttggatattttaagaagaaagtgtcttgcatttctcttgctggatggtcttgtggttcaaataacatatcaaagttccaaaactctgtttctacaattgggcttttcacttctttaaatcccatagctaataaaatctctttaacctctctaataattcttgtcaatggatggactttagctgggtatattggcttggtaggaacttttacgtcataaggtcttatatatgcttttttccactttccacttattataatatctcttgttaattgggtaatctcttcttcaatctctattggattttttatgaactcttttcctttttcagttaattttatctttatttctttctcttcatcaaaatctacataacctctcttttttaaaatgtctataatctttttttcctcttcactaaagtcgtcgaggtatttattttctttgattttttgtaatagttgttcttcaacatccttgtaatctaaattatcaaaaataattttacctttctcaatccttgctattccttttctttttatagcacctaaggcagcattaatttcctcttttggtaaaatatcttttaagtttttaatttcaatttctttgatgttgtgttgttttaaatagtttgctattttcctctctggaaactcttcttctttaatgagttttattatcttctttactttttcttctgtttctaccaaatttttaccttttaaccataaagaaacccttaaaatcttttcttttggcatgaacttctctaattcatttaaattaaactcatctctattattatcctgaaaaatctttaacaatctcttttcatctatatgtagttccataatcccaccatacagaactgctaaattttattctttttatagtattattttctttaataaatagataactatgtttatcaacccatgtttaaatctacaattcatcagtttcgtccatattcttattttaaaaattttcgtccttctttttctatttgtaaaactttgatattagaaattttaatggcaatctttgaataggacttcgcagtttgatatatccaataatgaactttaataatctcaattaataaaaatttattttagtagttaatatttaatttggtggttattatgcttaattacgatgatattaaaataattgatgaaatttatagtgagggttatttatttgctcaatatggcatttatataaagaaaaaatttaaacagaaaattttcaaaattcctgttgatattggacttggatgtcctcacaaaaaaaatggtggatgtatcttctgcccagagatgggaagaccaatatccgtcaaatactgcagtgcaaaaattccattaaaagagcaaattaaaaaacagatggaaaatcagaaaaagaaaggatttaaaaaattctatatatatttttatcctgggactaacacttatgctccagcagagaaattaaaagaaatttgggatttttccctatcttataaagaggtaattggcttatcaataggaacaagacctgattgcttagaaaaagagaaattggatattttagctgaatatgttgagaatggctatgacatttggattgatttgggagttcaaagtatgcatcaaaagacattggagattttaaatagagggcatgatgtttcagatattataaaagcaataaaggactgccataaaagaggaataaaggtctgtgggcatgtgattttgggtcttcctggagagagttggaaagagatgatggagacagcaaaaattttatctctgttagagattgaagcagttaagatatatcccttagttgttgttaaagggacaaaattagaggagatgtattggaaaggagaatataggacattagatgaaaatcagtatataagcttagtttgtgattttttagaacatctctctccttatgtgttaattcaaagattgtctaaggataaagttcctgaaagtattaaggtgtctccagaatggtatttaggtagattgaagattatgaataaagtgagtgagatattgaaaaaaagaggaactaagcaaggagcaagattttttagataatcttttttattaataactattttgtactaaaaagagcataatttattctctaagagatatgattttaatcaagtgcttattatttgttaaaaggtgaagcttagtttccattccgaatcggtctgattttaactcaaaaaagctaaatgctctgaaaactctcgttaaaaagtttccattccgaatcggtctgattttaacattcctatcataaatttaaactttttgataaccgaagtttccattccgaatcggtctgattttaacaaaataaagatgcaaatcatacaacaaaatctgagtatgtttccattccgaatcggtctgattttaacagaaaacaaaaagaacacataaaaatcttatgttataagtttccattccgaatcggtctgattttaaccaccacaataatcaactccaaaatcttcaacatatccacactcgtttccattccgaatcggtctgattttaactaacgttaaagagaataatgaagcaatatgcagatgagaattctgagtttccattccgaatcggtctgattttaacaaaaaaacttacagccctcagtatcctacctaaaaagtttccattccgaatcggtctgattttaacagaatttttagtatttaatcaaaatattaggtaaatagtttccattccgaatcggtctgattttaacgggaatttgtaggggtagtaaaagagataatttaaaagagttcatgtttccattccgaatcggtctgattttaacaagaaagaatacgcaattgagctatataaattgccaaagtttccattccgaatcggtctgattttaacatatcatcaatataatttcctaatatatctgtttcggtttccattccgaatcggtctgattttaactgttgaccatccgagaaatgattggccaacttatattattgtttccattccgaatcggtctgattttaacatcagaaattgacaaaactgaaataaaaaatagaattaagtttccattccgaatcggtctgattttaaccacataaaatgtaaaacacttgatgaatttttgttatgttagtttccattccgaatcggtctgattttaacaggaggcttatccacaatataatttatactactctcctaatatttaagcttttctacaccacatttttctaaggataaataactatctcataatataaatcttttagtatttaaaattttctccctttaataaaacagagcattcttatctccttaaatttaaaaatttaacttatttgttagagaaattttatttacttatctaattaatcttaattttcaaaaatctaaataattcaataaactcaaatattctaaataatcaaaccagctaacccttagaaattaaataaaaattctttgaactaattaataaatcctaaatactcttattttcaaatttcaaacatattcaacaagacaatccataaatcaattaacaaaattgaaaatcctatgcctataataaaattatcaaggtagtatcaataaatactaaatatatattgtcttttttgaaataatatttaaaggttatcctctccgtaaggatttttactatagtactcaactgtttttaacgcagagctaacaaccatctccctaatatttggaatctcctcctctaacttttctaaaatctcatgacatctccttctaacgctgtcccccctatccctactgtatggacacatatccttatctttataatactctatcccacactcttcaagagcttttattatatccctctccaatataggaagcatgggtctgattattatacactcctccaatggaattttaaagctttgataatcaacctcattgtatttaaaccttgtcaatggtctcataaactttaatctctctcctttaaagatatttgccaaaattgtgtctgaattatcatctaaattatgtccataagctaatttaaccttttcataagggatattttcattttcagcaatttctttagctaattttcctaacaaatgccttttaattacagagcaggaaaagcatggagaaaactccattcctttggaatgttttgtcaatatttcagatagttcaacaacatccaaatcattttttaatataatgtgtggcacatttagcatttcacagtgatgttttatcagcttaactccttctgtatcttctttccatggtctaattcccccaatattcacatctacagtaacagctattaattttattccatatttccttctataaacttccaataaatgcaataacaacaaactatcctttcctccactcaatccaactataacaatatcccttggagctataattttatgtttatttataaatctcccaaccttcgttgatacatattcataagtttttgaataaataacaggaattccaaactcttcttcaattttatccatctttgttcttgataaccttgccattcttttattattaactaaaatcttatcctttcttatagttaaaaagaatggatttgcatatttttttaattctcttaagttaatctctaccatttttatcccagtttgtttttttattttataattattctaatttcatttcatttaaatgcccaatggctttaaattaacacttctctctacaacttcagcaaagtaatttaaacttttttctatgctatctttgtatgaatctccataaatctcatccaaacctttcctttttctaattaaattaatgatataatttctaaactcataattttcaaatattccatggaagtatgttcctatagccaatccatctccaaattttttaatagaaccatcaaaaccatttccacagtttccaaagcctctctcaatttttatgagaggtttttcttttgaataggtaaagccttcatgtatctcatagcctttaacattaaatgttttattatcaatctctaagaaaccacaagagtttttaactactttatcatttccaaagtatgtttttgcatcaaagatttttaagccctcaatatctccaacatctgactctttcttctctttatcaatcaactcttttcctaaaacttgataacctccacagataccaataacaattcccccatctttcaaaaactccaaaaccttttcatcaaagttatgttgttttaaataataagcttcttttgttgaacttcttgttcccggaaatattaagatatctccagttatgtcatcatcaaagtcgataaactttataaatgcatcgtatcttaatgggtctaagtctgtaaagtttgatatctttgaaaacctaactacattaatttccactccactttttgcatttccaaaacttctcatgctctgtaggacttgactatcctcctctggtaaaacaaggttttcatcatagggaactatgcctaaaactggaataccagttagctcctctattttttcaatcccttcctttaaaacctctacattccctctaaatttgtttattataattcctttaattagcttcctccaattttcaggcaatagttttattgtcccatatattgaggcaaatactccacccctatcaatgtctgcaaccaaaatagctttggcatttacaagctcagctatccttaaatttgctatatcatccttcaataaatttatttcacaacaactcccagctccctccataataacataatcatactctctgtctaaaatttccaaactctctttaatcttctttaagaaaaaatctttattttttctatattcattataattcatgtctttgtagggtcttccatggactataacttgagagataaaattaccttttggttttaataaaattgggttaaaatgaactgatggctctaccctacaagctaaactttgagtgtattgggctatagcaatctccccatcttcctttgcaactcttgaattcaaactcatattttgagatttgaatggggctactttatagcctttatttgctaaaattctgcataatccagcagttattgtcgtttttccactatttgatgatgttccaacaaccattataaactctgccatcttcatcaactcagcattttttatagtttatttgagatttgattatatttagtttagtttattggatttttaatattgatattagattttttaattttgtttagagtattgtttatatttttatagttttaagatttggttttaagtttttatagtaaatattggggatttttgttaatagttatgtatcggatttatatgactatgcaaaacctttcttaatcttttaaaggttttaataatcatgcagtaaaaatttggatacggatatagaaaaatagttataggagttttagtataaaataaggacagaagtaaggatttgaacctttagttcattaaaacaaggattaagctaatgtcaaaaatcttaaaaactatttttatttaaaacctaaaatctatacattcaaattattagattatatatatttatagttgctctttaaaactatattttatcaaaaacttcaaaaaaaggtgactactttgttcaacttagaaacagaaagagttataagagaaattgaaaatttaaataaaaacaatccaaaagttatttttcaagctccagaaggtttaaagctgaaagttgaaaaagagattgaaaaaattaagcaatattttaaacaaaaaaatataaacattgagatttacctatggggaaatacttgcttcggtgcatgtgatttaatagacaaccatgttaaaaacctaaatgttgatttaatcatacactatggacacgaaaaacttagctatgcaaatccagagattaaaaccctcttcattcccgcatatcacatattcaataaagatgaagaggaaaaaatcttaaatgatataaaaaactttatagaaaaacataaaagtggaggaaaaaaagttgctatagcaacaaccatccaatataaaaacttttaaaagattttaaccaagtataatcttaggttgtagaggagaagttaaagaaggggatgttatattatttgttggaaccggaagatttcatcctttaatgattgcttataaatatcaaaaggaggtttttatatacaatcctctctctaagtgctttgacaagatatctgaagaagagattaataagtttataaaaaagagaattttagcaatatctaaactattattaaacaaaccaaaaaaggttggtgttgttttatcaacaaaaaaaggacagtgtaggaagagggtttttgatgagattataaaactgttagaagaaaacgatgttaattacctcccaatattagttgataatatttctccagatattttattctatgatgttgattgctatattatagttgcatgtccaagaatcgttttagacgattatatcttatacaaaaaaccaatttacactccagaagaatttaaacttttcttgaaaaatagctttaaatataagtttgatgaaattaaggaggatgatttctaaaattttattatctattaacagaatgtcctatttgttgctggtaagcagagagtttcaccacaatttggacatgttataacaaccttgtccttttcataataagctttaaatggttttttacagtaagggcagagatatatccttcctcctgtctctttacactctccaacctctccaactgttggatatttttcaaaagttatatcactccctttattttgatatttaaagaatttttcaaccatctttaagtaaatattaactgcagcttcatttacacaatcttttccacagtatggacaattatacatgaaatcacctcataaagttatttattgttatttaattatattatataaattatcatcttgccacatatattataaatatattccgtttcggttaacagtgttagttaattattttttattactcaatgttggtgaaattatgtggaagaaattggaaagcttaacaagtaaaatttatgaaaaggcgagaaaaagaaagggggagcatagaattgcattgttaattgatggaccaaacatgcttagaaaagaatttaacattgatttagataaaattagagaggttttaagtgaatttggcgatattgttattggcagggtttatttgaaccaatatgcatcagataaattaatagaggccgttataaaccaaggttttgaaccaaagatatctgctggagatgtggatgttgaaatggctgtagatgccactgagctcgtgtttaatccaaatattgacaccattgcctatgtaacaagagatgctgactttcttccagcaattagaaaggcaaaagaaaggggaaaaaaggttatagttattggagctgagcctggtttttcaacggctttacagaatattgctgattatgtaattaaaattggagaggaattccaattagatagagaaaaattagagaaaaagaagaaaaataaatttttaaaagttgaggaaaaacagaaagataaagaagaaactgaaaatagagaagaaccttaatcatttattttattccaagtatctttctcaatacagtagatgttgcgaatgaacagagaatataccaacctaaccaacctaaggcagtgttagaaactattttaaatcctcctttataaaatattgaaccaagccagtgccagaaatcaataaacaaaatctttgacaatattataggtagatacacaacaactccattccaaccaggatttaactcttgataaactccaccaaacccataaacatgcctcaaataaataaatattaaaattattggaacccatgtatatatcatcggcctaaaactcatcttcattaattcagcgttgagttgcataattctctgttgttcttcttgaagtttttccatcatttcaggatttttagacatttttttaaatttaacctgaaattcctgaatctccttttttagttcagcaactctcttctggtcaactaaaagttttgtagctatatttatgattaaagagacaattattgcaataattaaaattgctaaagcgggatgtagaacttttattataggcatgaaaattgcatccaaggttttataatatatgtcaaatatagaaccaaacattaactcaccttaatgtggttatttaaaaattattttaaaatattatataaggattatttgagaacttcaataagttcttgaactgctttatctaataaaaagtctctatttttaataattttaactgttgctcctgttaaaacagcataagtcatagccgcacatctattcataaagatatgttctccaatatcttctgttgattcgaaatctctctgtcttgtttcatcctttaatcttctcatcaatatctcatcgttctctgcttcaactaaaacaatgatatcaggatttaactcctccaaaacccatgctggaagccctgggagataacctttaggtgtttttattgtgctatgtgtatcaacaactatattgaattctttagccatttcagcaatcttttttcctgctaatttttgtatcctcttctgttcttctggaggcaacttccttaattggtctctatgctctactaaaccctcttctttagctatttcaaacatcacagtcccaaaattaactattttatattcaattccttccttttttaactcctcaattgccttattagttactgttgttgaaccaactcctggaactcctacaatcaccacaaccttgtttttcatcatcatcacctcacaaaattttagggattagaatttcaatagaactttcgcagtttatatattttttagaatatattgagaaatatggatgcttaaagggcatcattgttcaatgaaatatttacttctgcgaaagttctattcaatgactttacttatttaataattttgctattgctgggtgcaactcactcaccttctctcttaagagttgttcatacattctatatacaatagagacggttaataaaacccctgttcctcctcctaaagctccaatgaaattggctattgtagccaaaaatccaacgaatgcggagctcataactgttagtggaggaatatatctttttaatctatgctctattgctttttcactctttctaaatcctttaattgccatacctaatgaaccaattcttttagccatactttttgggtctaatccagtcgtttctacccaaaatataccaaacataacacaagtaattatcattgctatcatatatactattgcatgtatcgggtctgaaatcacacttgataaaccataaggagttgaaaggtaataggcaattccatctaccgcccttccaccttcataatgtccaagtatcggaattcccattctatataacgccaaaccccaaagttgtatatttgcaaataacgcagctgctaatataactgggatatttgagacataaacaaactttattgggtattttccaacagctcctttaattctcccatgagctaatgggatttccaccctcatacattcagcataaactaccattaagaagacgattattgtcccaattattggggctatatattcaatatttggaactccttgaattaatgaatttaaaaacttccataaatatccctctggacctaatgctccaacaaatattgtttgtgaaactcctgcagcaataaacaacccaatacctgaaccaataccatactttgaaacaatttcatccaaataaattaatattattgaaccaaaggctatttgaataattactaaaaatgctaacaatggtgttaaaattccaaatgcaccagccccaacgaatagaactgcttcaacaaaacacattattatagataaaagcttctgacatccttgaaacaaagccctattttctggaattgataagtccatttggataattcctgaaccaaccaataactgcataataattccagctgtaactatgggtccaatccccaaggttataagcgttccaattcttgatgctgtaattgtctgccaaaactcaaatatcgctggaatttgagctcctgctgtataaacatcaatacatcccataatgaaataaagaaccaaaactattcccgtccatttaagtttctctttaaatgttatctccttaactggcaattcaacctctggaattttttctaatattggaattaactttttcatgatgttttccaaggtaccacctttttttaagattttaagatttatgttttatattactgataatttttgtaattaggagtataaatttttagtgaaatttaatcccataatgaactaaaaatgaaataaaatagaaaaatggagaatatattgagtgcaaaaatcagccaacattttgtaaattccttttaagttactctttaaatttttaatatctttatttttttgtaaaaaaatagatactccattctcatctaaaaatttatttacttcaaaatcaaaaattagaaataaaaagaagattgttaataatttagagttcaacaacctctccacctactgcctcaatcttctctcttgctttctctgaaacttcaactgctttaacaatcattgggattgtaacttttcctttacctaaaactttctcataacctaactcaattacatcaacaacaaatttatcatcttctttttcaaatttatctgggttttttaatacaatctcttcaagctctccaacatttattgtttctaatcttttaactaagcttgggtgtctcttgaatccatactttccaaagtaatcagggcagtattttataatccacgtccatttgtgcttatgcccaccagccattcctcttcctcccttgtttccagcccctcttctcttcttgtggcttcctcctccacaggttcttgaacctctaatttttttaacttttttcttttttctaatcataaatcatcaccttacatcatcttttctaataactcattaatcttctctcctctgtaacctaaagctcctccaacactgaatggttttttaatacctcctctttcaaatccttttcttggagggtgtaatctgaatacaggttttaatggagtttcttttaatttaatttctccatttataatcttttctgccaattcttcaacatccattcctgtaagctcctttatgatttctggattaacttttttatttcctggtaatcttcctctctttaaaattaatttaaccaatgtatctttatcaatttctccccatgtcacgtagtctttaactttttgtaacattcctttaaatgtttctgtttctggaattattacacagtgatttactttgtgcaatctcaacattttcagtgtatctgctatatctctccttacaccaactctccctcttatcctaatgacagcataagccatattatcaccttattaaaataaaagttttaaaatagccacttggttttaaatgagaaaaatttaatttataagactcttccttcaacaattcccaacttctctttgtgtttttccatagttcttgtaaagttcaagctctttaatgcttcaaatgtagccattgcgaagttgtaagttgttcttgtctctccaaatgtctttgtccaaacatctttaattcctgctaaacctaaaactgccttagcaacatccccagcaactaaaccaaccccttttggagctggtaatatctctattgcagtacttccacacttcccataacccttgtatgggattgagtgaggtgttccacaaccacactcccaagaaccgcaacctctcttaactctaataatgtttttctttgcctgagctattgcctttctaattgctggcccaacttctttagctttaccttttccaacaccaacataaccatttctgtttcctacaacaactgtagctctaaatcttgctcttctccctgacttgtgcattctctggactaacttaacatctaaaactttctcttctaaatctggtaataaagcatcgacaatctcaggctctaagattggcagattgttatctaaaatgtaatcaatatcagttatctgcccttccttaaccattcttccaatagtggtttttggttcccactcatctatattaaatctcataatctcacctttagaacatactgtctatttttgcctttatttcttcaaagtgttctggcaatttttctggttctaatcccttctccaaatattttgagaactgtttcttgtatctttcttcatcctgttcttttaacatttcggcataagcctttatgtgttcccctcttatcctttcttctgatggtaatatttcttctccgtgtggaatttccatacccgcatctaaagctccttttaatattgcaaatattgcattaccttttgtagctctgtgcaatccaatatctaaaactgcttcagtgtaacctttggctaaagctttcttacctaataagtaacctgttaagtatgctgatggcaagtttcctgtatgccccttataacccaatttaatcaactctcttgaatgagctgaaacaactgttttatctcccttctcatcatacaatacaatttgagcaatgcagtgattcaaagttcttcttgctactaatcttggttttcttgataataataattttaatctttttctgtagtcagtttttgcttctcttcttcttctaaacttaaccctataagttggacctgttgccataatttctcaccttcctgataaaaattgtttaattattttaagagttcgtgttctctcatgtaaaggaagaggtggcttctacttctaaatgctcctccttttgccattctgtaaagttttctataaacttttctatcaatttttccagaatctctcaactgtttaagagtttttcttaaagctctaattgtagccatccatctttcttttggtggagttcttgcaccagcagctcctcttcttgaacctggacctcttcttctacccttttttctctgctctttcaactttttaactctcgcactgctaattcctttcttctgctttttcttaataactccttctttaattagagctcttatatcatcttttgacattgccattttgactctatctaattgagttgggtcaatccaaaccctctctattccacattttaatatctcagccgccattcttctttgaacggatacatccataattatcacctataacaaaagcagatttatcttaaagagtgagggattgaaaataatttattcgttagtttcattaacttcttgagcttcctgtttttcagctaattttaacaactcttcctgtttctcttctgatatgtttaagattcttattcctaactctcttgctcttatgataatttcaattttctttcttttaccaactgttgaagctattcttgctccctgtgtttctggatttaatttctctaaatcttttacattataaaccaaaacatcctccaatccacttgggtgtaagcctcttactgccttagggcttctgtaaccaatctcaacaactggaggtttttccttccactttaatctcatcttactgtgtcttccttttggtcttctccacttctctcccaaccttttgtgtctgtgagcttcttgccttataaagtcaggctttttcatttttaatttaaatcttaatcttaacagcctgttcataactctccctcaactaaattttttagatagcttttccagctttctctacaatgtaaattccatcctggaagactcttgggtctcttcctttaattcttgttgcctgctctatgttagcagcagtttgtccaactttttccttgtcaattcctgtaactatgacatcctctccactaatcttaacggtaactccttccataattcttgctcttcttgggtgtttctcccctaagaagttttcaatgataacttcattacctttaacgctaactttcattgggaagtgtgcatacctaatctttaatttgtatgtaaatccttcagtaactcctttaatcatattgtttatatgtgcccttatagtcccaaccatggccttgtcttttcttcttggatattcacagaagataactatttcatctccttcttttttaattacaatttttggatgctcaaatcttcttcttaactcttttcctccactttttacaacaacttcattattgtttatctcaacttgaacattttcagggatttttaccctttcctcaatataggcggcaactggcataaactcacctcaaaatttaaatttaatttagaacgtgtttaatagacataagctaacaaccttcctcctaagcctctctttttagcttcttcgtggctcataactccctgtgttgttgaaacaatcaatataccaaagtctcttgctggtaagtatctcttttcaaatttctcatagccaaattttttaactgggaatcttggttttattgctccacacttgtttatcttccctattaactcaactttaaatattccagctctaccatcttctataaattcaaactctcctatgtagccgttatcttgcataacttttaaaacccttccaattaacttagaggctggttttatatacactacctttttacccactctctcacagttagagatatggtttaatgcgtttgctagtgggtccattaaactcatgttttccctccattaagaatttttagtaaagagtgttttggtttaatctaattttttaaatcctaacttgtgagctatttccctaaagcactgtctgcagagatttaatccatactttctgattaaacctggacctacatgcccacatctttggcatggtctaattccataaccatatttctttttccatggtttttttgccatctacatcacctttttattgtgtttcttcttcctcctctaacaagactctttcaactttaactccaaatgttttttctataaattcaattgcctcttctcttgttaatctatgtcttcttggaatcttagctctgcatctttttcttctcttaactctaaatccaggtctctctaaggtaacacagacgtccatcccaaagataccaatcattgggtcgtatttttgtccagggaagtctatatgctcatgaataccaaatgagaagtttccgtaatcgtcaaatgaataatcatataattttttaccttctttttggaaggcttcaaatgcattctttaaaaactcttctgccttctttcctcttaatgtgacttttaacccaattggtaacttctttctaattccaaatgatgggtttgtttgcttagctcttgttcttattggtttttgtcctgttagctcttcaataacttgagctccttttgttaatctatctccactctctcctactccgaaattgacaacaactttttcaattcttggttttagcattggattcttctgccataactcttcaaagctcatgtttctccctcatctatctaatttataatttaattattggctcttcgtctccaacaacgaagacatagtctttaactgttttgaacttctctccatccatgttttctaatgtaacgatatcaggatatattcctcttctctcaatctcaacgattttagcgaaatcaccgacgtgttttcctcctgtaatgtatgctaatttaccaacttcaaatggtatatgagctttaatttcttgttcagggattgagattaataatgtgtctcctgttttatagacatcttcttctgcctttgtagggtctgaaacttttataacgatatttcttccatcgtgtaaattgagctgtatgtgtcctcctttaataacagtcttgtttttaattttacataattttacatctggattttctgttggttttaatttaattcttccctttctatcaaataaaactctgtaattttcatttgcatctggtaatgagacaacatccattaatccaactggaagcttttcttccttcctaactcttccatcaactaaaactttacccattttaatgattttctttgcttctcttgcgttatcggcatactttaaaatgtctctaacgattaacagtaatggtaatgactcactcattgggtgtgctcctggtaatggtctaactgtgaatttgtgaatctttcttggtaactcccatctaactggagctgccaatctttttaaatgtctttttggacctttttttgccatcctttcaccttattcatttttgatatgtttgaatcttttttcatccttgtcatacaacttgataatcataacatttgatggatggattggatatggaacttctcttccatcttgtctcttgttgtttgctccttcaacatatattctgtatctctttaaatcaactttgataacttctccttctaatcctttgaaatctcctctcattattctaacaacatctccttttctaactgggatagcgtttttacctaacttctccttcaactcctttgataacattgcagacataacttttcttcttaagtggagaggagcgttaaataatgcctttctctgttttcttggttgttttgactttgtaaaagccatgttttttcaccttaattagtttttaatttaaatgattatcttagcaattcttgcaatacctggccatctttcagcagcttccttagcaacaggccccttaatatctgaaccctttgggtttccatctggtgttactataacaactgcattatctgcaaacttaactcttgttccatctggtcttctaatctcttttctctgtctaataacaactgctggcaaaacctgttttctcatttcaggagttccttttttaactgtaactattaccatatctcctactcttgctgttggcaatcttcttgcaacccctttgtagtttcttactgcgatgatttcaacttccttagctccggtgttatcagcacagatacatctcgctccaacaggtaaagccctaacaggttttgaaccaattgctttcatgttctttcaccttttagatttatgagtcaaatttattcttctcctttaacttcatcaattcttcctaatttttcaacaacaacgaatgcctttgttttacttattggtctgcattccatgactcttacaatatctccaactcttgcgtgtatgcatggtgggttgtgagctgctaattttgttgttcttctctcatatctctcatatttcttgatgtattttacaacctctctctttataatgactgttttgtgtggtttgtcgctaactacaactccaacaaagctctgccctcttactggcaaatttccatggaatggacagtttttatcatcacattctacttctggagctttaacttgtattccaatatttcttgctgccatgtttttaccccctataacttattatttggcattattttgaaagacattatagattaaatgtggcatcaatatttactaaaacccatatttatactttaaatctcacagactggaagatacgataaagagtatataataatagccagggaatttttggctactgtatcattattctcaaacggttggggctaaaatagcctaatatggatatagtatctttatttttttctttaatctctcttctggtctccctattagcaatctcccatcgacctttactttgcacccctttagttgaaagagaaacactgcaatgtcttttgggattactacttccctaccatcctctttttctatcactaatgtatttcttgtttcatccactactttccctttaatccctatcatcgctttgttcttcgcttcaacaatctctactttaagccctataagttcatgccttaatatattgtgaggagttatcatgatgccccaaccgttttacggggacggggtgtgccctcctggggcatccgcgtcccctttatttcagaaagttaaaataaatttaaagttaaagttttacctgatttcaattgaatctcttgagaaacccattttaacaagttcctcagcaactttcttcctatggtctccctgaagttctattgtattatctttaacagtccctccacaggcacaaatatctttcaattttttagcaagttcttttaaatcaataacgcttgtatcaaaaccttcaattatagtcattaacttaccaaatcttctttttgtaacatatatttttattttctgttcttctttagctatttcttcacaaacacatagttcttttggtaatccacatcttggacagatttccggcatcactgcacctctgtattttatatgccatctgagtaattgagtatagtaaataatattaagatagggtatttaaattttttgttattattgggaggtcattcttttcttttcattcattattgttaatattcttgctattgttcttctgatttctctcattctacctggatttgaaggagctccagcaactgccttacttgctctctcttttaataattccctttttaattctacaagtttttcttttaattcttccattgacattcctcttaactcatctgctcttaatatagccatgtttcctcacctttactgctcttcttcaactacatgtttaacttctgcatcttctttaattataatttcatctggtaataagacatctggtctcatgatttttactgtaactcctatgacccctggctttgtttttgcaattgctcttcccttatcaacaagctcttcagcaggttctccacagtgtttcatatatccagccatgaatttttcagttcttgctctctctccagttaatttacctgagataatgactataacccccttagccccagcattcataactcttctcactgcagtgtgtccaactcttctgaagtgtaaccctctctctaatgactgagcaactttttgagcaacaacttgagcgtctaagtctgggttttctactggtttaacatcgatttgtggtttttcaacaccgaattctttagctaatgtttctgtcaattctctaattctacttcctcttctaccaataacaaaacctggtttttcagcgtagatgatgatttttgttcctataggtgtttttcttatatcacagtggctgtatcctgctttacttaactctttcttgaagtactcatcaattaacaatctcttaacattttctttaacaaatgttctttctatcatggatttccacctttatatcttatttttagtggtattcttctaatataacttgtatatggactgtttcttggaacttaggtgtagctctaccaaatgctcttggcatgtatcttttgattgttattcctttgtttgttgagatgtgttttattcttaacttttcagtgtttaaacctttgtattcagcatttgctttagcgtgttgcaatatctttaagattgccttagctgctttaactgggtatctaccagcaggccatcctaattttccttttctgtgccctactttcttgcagtgtcttctaaagagaactggtcttctcattgcaataacatcttctaagaactttattgcctcatctaacttcattccatttattgatttacatatctctcttgcatgttttcttgaaattgggatgttccttcccatagcccttgcagttttttcaggattgacttgtatcttatattttaatttacccatcattatcacccttaagcttaaaatgatttaactatatagtgtctttcaaacttcttaaataactaaggcactaatgaacgccttccaaaggagggcgttcaaacattccttcataaattttattaattttgaaaggcactataatcttactgtaagaagtttatatacttttattgttgtttaactcataacaacccagaatgctatattgtttcataaatataattaggctatcaacatttaaattgtagagcattctgggagtttctattttccaattatccattacagttctgtttatgattatttaaactatgaatttatcatcagcgacggttgagattttagaatgtaagaatataaaatttttaaagtgttatatataatttacgaataaataggaaacaacaaaacaaaaacaattttcagtccaaatattcaaaaaagtattaaaatttatgctaatgagacctctactgtttcaacactctcaacctcatcaatttctgctaaagcattttctattggctctgttcctccttctctttcttccatttcaataacggtgtatatagcgtataaaccaaaagctaatggctcatcaaataatcctcttatagcaacatcttgcttttctaaaacctctttaatcttttcttttagcttctctttattaacttctggacttgtaggcataatttttatttttgctaatactgttgccatcttttccctccaaaacttttatgggccttcaaacccgcattttggacatttgtatgggttatttaactttctgcatctctcacatcttacaatctctacttctccacagtttggacatgggaattttgttgatttctctcttggagcaatctcagcattacagcttatgcacacatatttcatctctcccacctaataaattttttatttaatgataacgtctcttaagtttgtatcatgtttatattttatctattccaacgatttttgtatatatattgtgttttccttctaaaatatccataactctttctggatgtctgccattaacaacgtaagcgttcattttaaattgttttaaaagaattggaaaggtctcatctacagatgttaaacctttaatgtcatttgcattaataatatttaatagtttccctcctgggaatttgtcatatatgccatcaacatcagttgctattataacttccctaacatctaataactttcctatatataaacttaatgaatctgatgttatagcccaagaatgctcggcaatatctgttgatagcaaaatttttgaaggtaataatatagctatcttttccttttctatctctctctttaaatcaaataatgtatcataagcttttatatatccaatttcagcataaacctctccaattaaatccatacattttatggcaagtttgtgagatagtgagtttgagatatttagagctttatctatctttctaacaacatttgcaaattctcctcctccaggaataataactatcttcttattattttcttttgcataattttttaatgcttttaataatggttttgcatcataagttagagaaccaccaatttttactatatgcatgttctcactatttcaaaatttcataaaacacttcagccatcttaaccaaatcctctattttaatatgctcatttggttggtgggcagtctcttctccaatgccccaaactgctacattatagcccttatatctcaaaaatgccgcaacagttcccccacccattccgcaaagcttagcatctctattcaaaacattctttatagcttttttcaattctttgataatttcagcgttttcatctgtgtaatttggattttcagattttaatatttcataagttatctctgcctttattgagttatcataatgcttaatatattttttaaactcaaagtttttgataaacttatttataaactccaaaacttcctctattttgtaagttggcaaaattctacaatcaaaaacaacctctacatatccaggaatggtgtttggattttcaactttattttttaatatcgttggttcaaaggttgaatactctgggaggaatattgaattaatttcatcaaatttctcatataaaccattatataactcatttgcaaagttaaaagccactatatcagcattcaacccattttctggtgtgctaccatgacattgctttcctttaatgttaaattttatccacagaattcccttctctccaatctctacaaattctccagttggtgttccaaagtcaggaactatgattaaatcatcctttttaaatatctcatcttcaaagttattcaatagatattttaagccatattcacttccatcttcttcatcagagacaaaaattaatgataagttgtattttggctcaatattattttcaaaaatcatttttaataataatagagaggaaacaatccccttatggttgtcctcacttccccttccataaatttttccatctttaataactggctcataaggatttgtgccccataaactaatatccccctctggaacagtatctaaatgagaaataatatgtaatgtcttatctcttccaaaatctattttaaatacaatatttggcctctcaataccatatttatctatgatgttatattcctttaaagtgtaattttctatattgtagctttcaacgtattccattaactttttcttgacgtattctgccttttctttttctccttttccaccaaatgaaggatttactgaatttattcttattaaatcactctctaactttatagcttcttctattaaatccataatctccctctaaacccaaaatattttagcataagctaccaatacaatcaagtgcattatataaattattcctccaattaataaaaaccttcccactctcacatttccgttggataatcttaaagttattaaattggcaaaagaagcaattaaagttccgttacctccgatatttacaccataagctattggtagccagtttttgtataaatgagatagcaacactgtagcgggcacgtttgagattatttgagatagtaaggaggcataaatcattaacataacattaccacattttattgaaaatatattaataattccaatcctctttagtccctcaatatcaacaaataggaagatgaaagttagtaaaaacagataatccactttaaccctcttatacattaaaattgccagtattaaaggaagaatatatataaaattcaaatatccaaaaacacataacaaaaccaaaataaaagataatatataaaaaatccactcttttttaaacttaatgtcaatatttatcttagtatcatactttttaaattctaagaatggtaaaatagccaaaattccaaaaatttcaaagggaatcatattaattataaactctaaagttccaatattatagaaatgaaataaaaatagattttgaggatttcctataggggttaagccacttccaatatttgcagagacaccctcaaagataatgagcttttctaaatccttaaaaggcatatttgtgtatctgtgaattattagagttaaagggatgatgacaaataaagagacatcatttgttattaaagaagataaaaacagagttaagaatatcaaagcaataaaaatcctcttagatttctttaagatttttaaagaaatatagtctaaaaactttgtatctctcataatgtttatgataaccattaaataaaacaaggaaaatattgttttccattcaacaatatgaaatacctccattggatttattatattcaatagcaaaagcaaaatcccaatgctaataaacatcaaaaatataaatgtatcaatcttcatactttccctctatggtggttaattatgaaatgctcccaatgcaataaaaaactttgctatactggaaaggactgcaaaaaggatataacacaaaaaataatagaagaatataaaaaagaagaaaatttaaagatagctgaggtctcagcctacattgaagcaacctattatatgaaaaaaacaaggttggaagagataatagagttctgcaaacttatggaatataaaaaaattggtatagcattctgtattggcttagaaaatgaggcaaaaatattagctaaaattttatctaagcattttgaagtatattcagtttgctgtaaggtttgtgggattgataaagatgtttttaaatttaaaaaaatcaacaaaggagaaaaagaggctatgtgcaatccaataggacaagcggaaattttaaatgagattggaaccgatttaaatattattgttggattatgtattgggcatgatatcttattccaaaagtattcaaaagctccaacaactacgtttattgttaaggatagagttttatctcacaacacagctggagcaatttataccaaatactatcttaaaaaactattagagggaaaataatgacaaaagatttaagaccgataatatgggatgatgataagaaagagctaattttgatagaccaaaggaagcttccaaacaaattggagtattttatctgcaaaacttatgaggatgttgcctatgcaataaaagacatggttgttagaggagctccagctattggagtctctgccgcttacggcttagctttagctgaaattaatggagatgatatctataaagcttatgaagtattaaaaaatacaaggccaacagctgttaatttattttgggcattggatagatgtttaactgcttacaaagaaggaaaatcaatcttagatgaggctaaaaaaatacatgaagaggatatagagacatgtaaaaaaattggaatgattggagaaaaacttattgaggatggagatacaatcttaactcactgcaatgctggagctttagcaacatctgcttatggaactgctttaagcgttattagatttgccttctacaacggcaaaaagattagagttatagcagatgagacaagaccaagattgcaaggggctaaattaactgcctttgagttaaattatgaaggaattccagttaaggttataactgacaatacagcagggtttttaatgcagaagggagagattgataagattatagttggagctgatagaattttagcagatggaactgtctataacaaaattggaacttacagcttggcagttttagctaaatatcatagaattccattctatgttgctgcaccattatcaacgtttgatttaagaagtagtgaggaggatgttattatagaggagagagatgagaaggaagtggcatatatagatggggttagaatagtcccagaaggagttggttgttataattatgcctttgataaaactcctccagatttgataactgcaattataactgaaaagggcattgtaaagccaaatagggatgagattttaaagctctttaggtagagactatgggatgtattgataagctaaactatgaaattttgtataaaggaggctttaaggagtgtgcagaatatataaggaaaaatttcaaaaatatcaaagagatggaagctggatatgagatatttgaaggaatttttttaattggaatccctccaattccagttgcctacgaagataattatgtgatattcccttacacaaaaccatgctatggaacgtttgttttaaaaataaatcttgatgaaataaataaagataagaaagaggagaaaaaagagaaagataaaggcaaaaaaggtttattatcaagattaaagttctggtgaaatgatgagtgtcttagttatagttggatgtccagaacctccagctttaatcccttctgttttatatctaacaaatcagctaaagaaaaaaggatttaatgtcattatagctgcaaatccagcagctttaaagcttttagaggttgcagatgatgacaaatactatttaaaaggtgttggagctgttgatatagacggagggcttagaggcattgaaggtattaataaaattataagttttgtccataacgacggaggagttagttatactgtaacttacaaagctaaatacaacaaacctacctatgcaattgtctttggaaggcagataaataaagattacgttgagacattaaaaaacagcaatataggggtttatactgcaagagccttccataacccaatgccaattgtaaatagaataaaggagattttagcaaatctttaaacttttttaataacctctaaaaactcatctaccttttttaaatctttctttccaccgtaagcttccaatgaagaagatacatctatagcgtaaggtttaactgtttttatggcctctaagacattatctttatttaaaccaccagctaagattagtggtttttctaaagactctctcaacttcttagatactgcccaattgtgtgtttttccttcaagttttatgctctctatctttgtatctaccaaaattgcctctacatatttttcatactctttagcagtgtttagcagagttttaaaatcaatttcttcatctttaggaatgtggataactttaattatatgagcgttcaattcccctgtatttttaagtttatttaactctttaacaaaatctaagctctcaaatccatgtagttgtatggcattaggttttaaggcattgtaaatctctaaaacttcctctatgctatttggcatcaatacagtaactaaggatgtgaatggagcaacatatttttttaactcaatggctttatctaatgatatctttcttggtgtctttactggaacatctactataactccaactgcatggactttttttgagatatatgctatatcctcttcattagtaattccacaaatcttcaccttaaccaaatcatcacccaaactattttattaacattattttcttttttctaatgtcagattcgctatcttttttattatccttaccttggttaatgttttgtatttctttagatttatcactaatatctccactagtaacctcatcaataatctgcaatagataatttacaagttcttttaaagtagaaataatttctggagcaatttttatcaaatcttcctctgttattactcctacgatttttccatcatctacaataaataattcattggttttatatttgttcatgatttctaaagcttcatcaatggttgtatttggtggaatagtaactaacttacctgaagagatatcttccaccttaaccttatctggaggtaattttctaatcaataccttttttattatgtctttatctgtagctacctcaatactctcatgatttggtctttcacatactacaagaacacagggaacgtcttgttcaaccatcaattttgcaacatcatatactgatacatccccactaactactattggttttttcattataagcagaactggaatctcccccaccattgtaactccccaatttatcttgaaactttaaacatactttccctttaagattttggatttcttaattatttttaactccaattatatttatatcttatagtattataataaatatttgcatatttaagtattttttaaatttttgtacatatttaaatttggtatagtatcgattataccgaaaagtttatatataagttacacatactttaatttcgcttgtggttgagggctcgtggtctagatggctatgatgccgccctgacacggcggtggtcgggagttcgaatctccccgagcccaccataattttaagccttttctaagttctaattcccttttgatgaaactttttctaaaagtttcgtttgtatctccccgagcccaccataattttattttagaaaaattaatttattattttaaatatttcaatttaatatttttaaaatatctaaaaacttattaaaaaactaactaatctactatatccacatgaacataggccctctcgacattttccaaactttctaatctatttttaactgcaacttcaatatcgtgcatctcttttgctgaaatatttgatggaacttcaacatgtaattcaacatggattcttggtccaacatagtgagcttttatatcatgcactccaataaccttatctacattcaaagcttccttttcaatgagttcaaagaattttttaggtggagcccttccagttaagtaatctatattggtcagacatatatcaaaggctacctttgcaatcatcaaagccacaattatcccagctatagcatccccatagtagataccaaacttttgtaacaacaacccaactaaaactacaacactgcttagagcgtcacttctatgatgataggcatctgcaattaaaacttggctatttaatttttttccgacaaataaggaatatctcgtcattaactctttaacaactattgataagatagcaactccaaccattatggcatttacctcaattacttccccataaataatcctctctactgcaaactttccaatctcgtaggctgtgaaaaataaagctaaaccaataaaaaaagaaaaaaggcattcaaatcttgagtgcccatagggatgagattcatccggtggttttgatgcaatttttactccaataatcccaataatacttgttataacatccgataaagagtgtattccatcagaaattaaagatatacttgaataaacatatccaattattatttttatcaatcccaacaatatatttccaacaatactcaaaatcaatggcttttctacctctctcataatcagcccctaaatcccaattatcttccccacatgcccataaacaaagttatttaattgagataattttgttaaagctttgaatccagtgcagtgcataggcataatccaaaaatcttgagatttgaaataatcaacaatcctatttaaatagttatctgaaacccctactaaatgaaaacctcccaaaactcctttaatttcacttaattttttcccatattcaactacatttataattccactatgagaacagccagtaattaaaattcctttagctattaagaacatgtcatcatttacctcatcttttactctctttccatctttaatacactgaaactcttccatctcatattcatattctcttggaacatatccagagacaataatatctttatctattttatacggctcttcaataatctctaaatcagctttttttaacaaatattcttttatttcttcgtcaatccctatgtatctattgccagcgtatttgtctaagaatgcatctttgtgagctataactttcccattgattaaatcgttctctataacatattttaaaccatcgcagtggtcgtaatgtccatgagataagacaatataatcaaatccttctttttcattaaataatctcaaattctctctcaaagttattgagttttgtccagcatcaaataaaattctcttattatttatttctatcaaagctgaaaatccatgttgagcaaaaaattttttataggcagtgttatctaccaatattttaatcatgatgtcaccaaatattttttatagcagttatgtttgtgtagcatcagatttatattttcccgcatttgaggataaattagttaatcatcaaataaatattttgttatagattaaaaattggtgaatatttatgaatctcaatattaaagaaattaaacaaaaaatcaatgaatggaaaaatagagaatggagatggaaaggaaaaggaaaaattgaaatcagatttgtttgtttaattgaaagggctgagagctttaaggaattggtagataacttagaaataatcatctgtgaatatgaaaaaataaaacagcttattgaagataaagatataaaagaaatagccaaattaaatctattctgtggaaataacgtttatgaagaaatgttaaaggatattttaagttcaaataagttcatatctttaacaataagttttgatgagaacatagcttatgttaagtatatggaaaggggaaaagaggaagttgtatatttagatggaaaatctgcctataaggccctacaaatattaaaaaatagatatgagaatatcttaaaaaagcagatatcaataatagaggacgctattcctttaaccatcccatctcaataatcttattataaactttttcacttaaccactcttcacttatgtatttatcataaactggcaatctcatctttaactttaaccctaactcctcagtccattccctcaactcctttatttctggccactctgcctctggattaacgtagtcccttgttagtggagaaactcctccccaatcatcaacccctgccaataaaaacaactgccccgtctctctatttaaatttggaggaatttggattgaaatatcatctaaaatcaactttgctaaaataataacctttaacatctttattggtgatggctctttaaaattctccattggaatgcctttcttagctctaaagttttggattataacttcctgtatatgcccatacttttcatgaatttcttttattttaaatagtgaatcaacaatttcctcatttgtctctccaataccaattaataaaccagttgtgaatggaatctttaactttccagcattttcaatcatctctatccttaactttggatgctttccagggctgtgtttgtgggcaattgtattcattaacctctctgaagcattttccaacatcaaacccatagatgcattgacatctttaagcatctttaactcatcataatttaagattccacaatttgtatgtggaaggagagaagtgttattcaatgtccattcctctaaatcgtagagatattctaatatattatcataacccattgattttaattgttctttaatctctttattttcatctacgtgttccccaaatgtaaataacgcctctctacatcctaatctatctccctttaataaaatctctttaacttcattcggcttcattaaacttggcttatcttctctaaagatgcagtatccgcacttatttctgcaccactttgataaaggtataaagacgttttttgagtaagttatatattctctcttaaatgtattattgatttgagctaatttatctaatatatccttagaagacgttgagttaaggaaattaattgcctcctctctacttatcatcctatccacctttaatattgaagaaatttaaataacactaaattttattgtcaatcaacacatatatatagtgagagtatataaagtagatattacaaacccatagacacaaaaatctaaggtttattaaataggacttaagcactttatattggacatttggaatttagataccaaaggcaccaatattcaatagaaaagatttattactgcgtaagacctattaaaacactcaattttgaaattttgataggataacaaaactattaatatcaacaaacacaaaataaaaatattaaaaataaaaaaaaggtgataaaatggctgaacagcaacaagaacagcaaattagagtaagaattccaagaaaagaagagaatgagattttggggattatagagcagatgttgggagcaagtagggttagagttagatgcttagacggaaaaacaagattgggaagaatccctggcagattaaagaatagaatttgggttagagaaggagatgtagttattgtaaaaccatgggaagttcaaggagaccagaagtgtgatatcatttggagatacacaaaaacacaagttgaatggcttaaaagaaaaggttatttagatgagttactatgaaactttaagaaagttacatgaaaactcttaaagagttttcatagcccgaagctacgcttcggtttcatcaaagctaacacctccttgctacgctcggaggtgtaaattaaatttgggggtatatccacagaactttcacagctttataatattcagtttggaactttgacgccttttaggcgtccatatcaataaggatactttcctgtgaaagttctgtgccaatagggggcgaagccccctatggaaagaaaaggttatttaggtgagttgttataaggtgatgcctatagctaaaaatattgatgatgaactctatgagttaaataaattgcttagtgaaaaagaagagtttcaattggatagagaatatcaaaaagaaattttagagaaagagaggaagtttttagaagatttaaagaccgctaacgaagtttttgataaaagaaccttaatgactttatttagtctattagctggaaagcatttaactgaatatatagggatagttaattctggaaaagaggcagtagtatttaaagcacgaaagggaaagttttacagagcagttaaggtttatagggtagccacttgtgattttaaaactatgagtaaatatatccaaggagacccaagatttcatttaaggaagagtagtagaaggcaaattattcatgcatgggttgagaaggaatttagaaatctaagaagggcttctgaaattataaatgccccaaaggcaagattaagaagagaaaatgtcttagttatggattttgttggttatagaggaattccagctccaaaacttaaagatatgcaagatttagattgggagaaatattttaaaattataaaagagagtatgaaaaagctttatgaagaaggagagttagttcatggagatttgagtgaatacaacatattggttaaagatgatgagccagtatttattgatttttctcagagcgttataacccaacatcctttagctcatcccttacttattagagattgcataaatatatgcaatttctttagaaggaaaagggttgattgcaattacaaagatttatacaaatatataactggaaaagagatagacccaattgatgaagcgatgattaagcaattgtaaattagaattcttatttctaatttttattttatatggtttttatatggtgataattatggtttttggaaatattggacaagataagagcattgagattttaaagattccaaaggatagagtaggagttttaataggaaaaaagggaaatgttaaaaaaaccattgaaaaagagcttggagttaagttggagattgatgccgatggaacagtaaccatctatggaacagataagcagaaagaccccttagctgtttggaaggcaagggatatagttagagctattggtaggggatttaatccagaaattgctctaaaattggttagtgatgagtatgttttggaagttatagatattgaggactatgcaagttctgataacagcataaggagattgaaaggaagagttattggtaaagaaggaaagtcaagaagatacatagagagcttaactggagctaacgtctctgtttatggaaacactgtagcaatagttggagagcatgagccagttcagatagctaaagaggctgttgagatgctcttaagaggagcatcccatgcaaagacatataaattcttagagagggaaagacagaagattaaaagggcaagatttgagttatggaagaaaaagagtgatgttgatgagttatatgagaagatgaatcccaattatgaagagatagagattgaagaagatgaagatgaaatagaggatgaagaataaattggtgatgaaatatgcacttagtaggagttttagacattgccaaagatatattaaaagcaaataaaagattggctgataaaaacagaaagctcttaaataaacatggtgttgttgcatttgacttcatgggagctattggtagtggaaaaaccctactaattgaaaagttgattgataatttaaaagataagtataaaatagcctgcattgctggagatgttatagcaaagtttgatgctgagagaatggagaagcatggggctaaggtagtgcctttaaatacgggtaaagaatgccatttagatgctcacttagtagggcatgccttggaggatttaaacttagatgaaattgatttactgtttatagagaacgttggaaatttaatctgcccagctgattttgatttagggactcataaaaggattgttgtgatttcaacaactgaaggggatgatacgatagaaaaacaccctggcattatgaaaacagcggatttaatagttatcaataagattgatttagcagatgccgttggagctgacataaaaaagatggagaatgatgctaaaagaataaatccagatgcagaagttgttttattaagtttaaaaacaatggaagggtttgataaggttttagagtttattgaaaagagtgttaaagaggttaaataggactttcgcagggataaatgttttatttaaatgaagatgcctttgggcatcaaattaccttaataaaatatataaactgcgaaagtcctattaaagaagcataaataatcccatcactcccaatatagaactgagcataatccttaaatgctttggagaaatcttttgatttatttttatccccaattttgatgagtagattattggaatagccataattaaagctattggaattgaaacatacccgatattgtagatatagccctctgtattagctgttaaatatgatatgagcccaccaattgaagttaatgggataacacctactgaaattgcgacagctctttttacgggatattttgccattgctaagattggaattataactattcctccaccaatgccaaataatccagatagaaacccagtaataactccacagagaataaaaggttccaatttatcttctctatctgagattttatcaatatgatgagatttagccatataaattgcatttgctattaaaaaaattccaaataactttttcaatatagctgaatcaataaaattaacaactaaaaacccactaaaataagaaaaaaccaagctaataatcccaattgttattgatgccttccaatttatatttttaatttttgcatgcctaaagattgaaattatcgaatttataaaaactacaaacaaagatgttcctacagcaaattttactccatctggaatgccaaaataatcaaaaataaatgttaaaattggagctactaaaaatcccccaccaataccaaacaaactgcctaaaatccccactataaatccaacaataattagtaaaggtaacaataacaaaaattcaaattccaatttaatcaccataaaaataaaatactaacttcaaatactgaatcttttattgcttctctatatataagttgtggttgtgtcaatatacaccacagacagtattttttaatataaacattagcacagtattttaaggaaatttgaataatacgttatacacccataactgtcctaaacaagtctctaagtcctggagccaatccaagagccattatgcagagttttataatattctttatattttcatcctcaacttctttatttaaaatatataaagctaataaaattattaagagcttaaaaggaataaaggcataaactccaaaagtttccatcaaaaatcttggaattggatgttgttcccaataaccataaactcctattccaatagttgttgcagaagcatcaatcaactgcccaatcacaacataatcatcaatctttgactgtatgatatttaattttaaggttttatctaaaaatttaactaaataataaaatattccaactaagattccaacgtataaaattgcttccaaatgagttatatgctgtaaaaacacgaataaaaaatacaacaatagaattaacccaataactgcagatgctttataatacttctctttaaataccaatccagtagttaaaatcgttagtataaaaaatccaccaatcaaaaacactatgcctggagttatagttaaaaaacttctctctatgtagccacaatcaaccaaagccctcattagagcaattaagacagtaaaaacaatccctgggattgcaaatttctcatcaatgtttatatttaactttctcaaagctttataaaataaatacaaagctaaagctaaaataatcccataagttatttcttgaactatattatagccagttcctttctcagctggttcaatataatacttgtagataaaattttttatttcttgaatcatcctttccctcaaaatatttataagatgttttattaatgtgatatttattaaagttgaagtttttgaataatgagacagaactaacttataatacaaaaattttaaaaattattgaagagaagtttttataagaaatcgattgaagctgaaattttagtagaggttttactttaccttgaattatatttatagttttattaatggtgattttatgagattttttaatagagaaaaggaaataactgaaattttgtcaattttagagggaaatccggatttagtttattttgtttatggtccattaaattcaggtaaaactgcactaattagcgaaataattaacaataggatagataagaataagtatgttgtattttatataaaccttagaggtatttttatctctaaatataaagattttattgaagtattatttgaagagtatgaagaagatagaaagccagtagaaattataaagagtttgataaaggacgttccttctttatgtggtattccaacaccaaaaaatacattagaagaaatcttgaagaaaaagacaactaaaaatgtctttaaatacataactaacgtattaatggatattaaaaaagaaggaaagcaaccaataattattattgatgagttacaaaagattggtgatatgaagattaatggattcttaatttatgagctttttaattattttgttgatttaactaaagaattgcatttatgtcatgttttttgcctaagttcggatagcttatttattgaacaagtttatagtgaagcaatgttaaaggatagagtagattacatcttagtggatgattttgataaagagacagctttaaagtttatggatttcttagctgaggaaattctaaataaaaaactatctgatgatgagaaagagcttatctatagctatgtagggggaaagccaattttgataataaaagtaattaaaaaattgaaaattaaaggtttaaaagaaactttagatgaaatgcttagggatgaaatgcaaaaactaaaatacttcttagaggacattaaggagaaggacgaagagtcttataacaaaatagctgatgcattagagatatttaaagatagttatgaaattgaagatataaaaatacctaagaatattagagaatttttagttaagaaaaatattttattcttaaatccacaaaaaggaacattgaaaccccaaagttatttggtttggaatgctataaagagattattataaagttaaataaaacacccttgtcatcaaaccaccaaacatgacattgaactcctccttaacctcaaagttattttttgctatagcatctttaaacatcttatcttcagcagttataactatcagccttgaagagccgtgcataatttcctttgcagaggataaaaattcatcgtatagctttttaactgatcttttgctacctatccttatgccataaggtggatttgctataataacatcactttcattaaatttttcatgcaattttgtagcatcaccacagataaattctatagtatccaaaacctcagcatttttggcattatctttagctccatccaagtatttttgatttttatctaaaccaattattttgtagatgtttttattttcaacaatctctttttttattttatctaataactcatagccaaaaatatcaataaacttaaaaccatatttattctctctaaactttcctggtgggatattcctcttcatcaaagctccctctattggaatagtcccacttccacacattgggtctaataacatctcatcatctttccaatcacttaaataaactaatgacgaggcaatagtggcatttaaatgtgctgggtgattaaaaactctatatcctctcttatctaatgcaatatcccctgtggtatcaattccaacaattagctcatcaaatataacttcaaccctaacaattacatctggttcatctaaattaactttaagcctaatgtttttatctctctgatatgattttattactgcttcaccagcaactcttccaatgtctattgatgtaaaattatgttctccagcccttaatgggcgaatagcaaaagattgattttcttttatccattcagtccaatcaatattataaactctcttataaatatcatctaaggctatgtttggaatctcttccctatgtagtaagatattcatcctttctatagttcttgagaggtagttaatcttaggaattagttttaaatcaccactaaaaaatattcttcctttattttctctaatctctttaatttttccaccaaaagattcaatctcatttttggagattttttcaagccccggggatagtgtaacatagtaatccataaaaatccctcttcttttattatggactttcgcagagataaatttatttattgaatattgatgcctttaggcatccaaataccttatttaatatataatgcgaaagttccatttaagtgtagaattttttatattggttgtgagataaaattattagttataaacaaaattatgtaaggtgagttaaatggaaattatacactacatagttataataatgacgttgttatcaagtttagcctccctcttacaaagagatttaattaagtgcattatattatctggttttgctgggttgtgtatggcttatttatactatgcattgttagctccagacgttgctttaacagaggcaatcttaggaggggctattttaccagcattgtttgccttcacagttagaagaactcaaagaatagatgaataaaaaattatttctttgtaaaagcatattacttttttaattaaaatttaaaaattcgttaggaggataacatgatgacttttgagataaaacacagagatgcaatgggaagaatagggatcttaaacataaatggaaagaagattgagacaccaacaataatgcctgttatccacccaaatccaaaaaaacagattgtatcgatggatttaataaataaattggcagatgttatcatcacaactcatacataacctataaaacaaaacatttaagagaaattgctgaagaaaaagggattcacaaattaattggctttgataaagtaattgttacagatagtggttcttttcagttaggagtttatggagatgttgaagttgaaccattggaaattatagaattccaagaaagaatcggagtggatgttggaacaatattagacatcccaacaccaccagatgttgatagagaaagagctgagaaagaattagaagaaactttaaagagagctaaagcatctatagaattaaaggaagagagaggatttaaattattactaaatggaactgttcaaggatctacttatttagatttgaggcaaaaatctgccaaagagatggccaagttaggatttgatatctatccaataggagctgttgttccattgatggagcaatacagatacagagatgttgctgaaattataataaactcaaagatgtatctaccaacaaacaagccagtgcatttatttggttgtgggcatccaatgttctttgctttagctgttgctttgggctgtgatttgtttgattctgctgcttatgcattatatgctaaggatgacagatatttaactgaaagagggactttacacttggaagagattaaagatttaaaggcatttccatgttcatgtcctgtttgttcaagctatacaccaaaagaattggcaagtttaaataaaaaagagagagaaagattgttagctgaacacaacctatatgtaacttttgaagagataaatagaataaagcaggcaataagagatggtagtttatgggaattggttgaggagagagttagatgtcatccaaagcttttggaagcttatagggttgttaggaaatacatagactatattgaaaaattcgacccagtaactaaaaaatctgccttcttctatactggaattgaatcgatgtttagaccagaggttttgagacataagaagagattgaagaggcttagatatgaaaaagtttatattacaactgtatcaagctctatagaaaagccatatcatgagcatttaaatgtagttgagacagatgtcgatatcttaattaaagacccagtctttgggtttattccatactacatagataccgtttatccactatctcaacatgaaattcctgagctttttgattatgaaaaagaaataaacaagaggtttgttgatgaatttattgattggttaaagaaaaaaatcggagaagacaatatattagatataatgacctacaattattatataaattacttctctgcaaataaaaaaattaatgccgatgctttaaggattaggaaaatgttacagtatcagtatggttttgatataattgacgatgaactaatgaataaaataaaagttgttagaagcaaaactactggtagattaaggcaggttttggatgaaaatggagaaattttattctcagttaggagtaatgacaacctcttaataccttctgaaaaaggagccaaattgttgtggaaaaaaattcctttcccaaaatatagggttgttgttaataaagaggcggaggaatttgcaagagaggggagaaatgtatttgccaaatttgttattgattgtgatgaggagttaagaccttacgaagaagttttggttgttaatgaagatgatgaactcttagcttatggaacaacgattttaaatggtattgagttaagagaatttaattatggattggctgttaaagtaagaggaggattaaaaataaataagtgataattatgaatatcaacgaaattaaaagaaaaattatcccaattctattaaaacatggtgttaaaagagcatcaatatttggtagttatgcaagaaatgaacagaaagaaacatccgatatagatatcttagttgaatttggggaggggaagagtttattagatttggttagattaaagtatgaacttgaggaagttttaggaaaagaggttgatgtattaacctacaactccatacatccacttttaaaagatagaattttaaatgaagcggtggatgtgctatgagaaaagatgtaaaaatttatcttaaccatatattagaaagcattgaacttattgaggaatacactaaagataaaactgaagatgatttctttacatctaaatttttacaggatgcagttattaggagaattgaaattataggagaggcaattaaaaacctacctatggaatttagagaaaaatataaccatattccatggaaagaatttgctgagatgagggatatcctaatccgtaaatattttggggtagatttaggtttaacttgggaagttgttaaaaaagatattcctaagctaaaagaagagattttaaagataatggaagagttagataaaaataaaaacaacaaatataatgtatttgcctatggagagttgatgaaaaaagagagactattggagttaataaatagagtgccaaagatgattgaaggtagagtttatggttatgagaagttttttgatgaaacaattggatattatggagcaaggaaaaaagagggaagttatattgatggcattatattgttagatattactgataaagaattagggatttttgatgactatgaggatttagacgtttattatattagagagaaaactactgctgtaagcgaagatgggagaaaatatgatgtatatatttatttgagaaaataaggggatttttatggatgcaaaagaaatcttagagttagttgaagaaagttataaatcagaagatggggactataaaaataaggtttattttatttcatattttttaagttctttgatttttgttttaattcatatatctataaaatactggaattttaatattttattcatagtttcattgttattaattattggaagcatattaattgttagacaacaaaagctttataaaaaaaccagatgctattttgataaaattttcgaaaaaattgttaaatatggaatgattgcagttgttctttcatctgtcattactttatacacatatccaagaatttcaggggttgctattgcaggtattttcggttttttattggttattgatggaattttatttaaatcaaagaagagaaaatttttgggactattgatgatgttctcttcaattccaatgtttatatttcatgaatatcagtttttaatttttgcttttgttcagtttttagttgctttatgttttttaatatgtaaagaataagtgaaattatgaaaatatttaactctgttgttagggttaaaatattggccttattgtatggtttagaatattgcgaatttaattatttaaaagaaaagttaaatttaactgatggtaatttagaacatcatttaaagaaattggaagaatgtggatttgtagagactaagaaatcagtaataaagggtagggttaaaacaataattaaaattaccaataaaggcagggttgcattcaaaaactatatatatgaaattttacaattatcaaaaaatatagagtgttaattttcaatgttcgtttaattattagacatttttaaagttgttattaggtttataaataagcctttattcttgtataaaaatttagtgtttcatattatttttgtttgagttattaataatatccggagttgtcaattatgaaactaataaaaaagaaactactatctaagagagggcaatcatcaatggaaatcatcatattagcgagctccgcatcattagtagccataactatagcatatttttttatactatctgcaaaaaatttagggctgtgaaatggggcaaagttgggggaaaagccaaataaatttatanaccattacccataaatcctcacattatacaggattattaaatgattcaatataatcaaaattactattattctctgtaatgcaaagtaatcaaaaagtatatataacaaatatggaaaataaataaaatgtgacctaaaacatatgattaaaacatagggaaaataaaaaggtgggtaagatgaaaatcttaaagaaattattatcaaagaaagggcagttatcaatggaagttggagttttagttgcagcagctgtattagttgctataattgcagcatacttctacgtaaaaaatgctaaaagtgcagtagcaagtgctggaaataaatcagcagcttttataaatgttactgctaataaatcacaggaatacattagtaacttaagtaatatttaaattgtaattgtaataattttatttttctttttttattttttattatttttatctatatatctaaatatataattataattttcaaagaaatttaaaaattaatgctaaaaatgtttttaataccaaatgtagatataaacccaacaaaatactttttggtgataggttatgattcttagtgataaagatattattgactatgttacatcaaaaagaattattataaagccatttaacaaagatttcgtagggccatgtagttacgatgtgacattaggagatgaatttataatctacgatgatgaggtttatgatttatcaaaagagctaaattacaaaagaataaagataaaaaactctattttagtttgtcctctaaactacaatttaactgaagaaaaaatcaactattttaaagaaaaatataatgttgattatgttgttgaaggtggtgttttaggaacaacaaatgagtatatagagcttccaaatgatatatctgcccaatatcaaggtagaagtagtttaggaagggtttttttaacttctcaccaaactgctggatggattgacgctggatttaaaggaaaaataaccttggagattgttgctttcgataaaccagttattctatataaaaatcaaagaattggacaattaatatttagcaagctactatctccagcagatgttggttattcagaaagaaaaacatcaaaatatgcctatcaaaaaagtgttatgccttctttaatacatttagacaatcataaaaaagattaaagagaaattattttctctttttcctcatctcatataacattgcctgtaatccatgatacttaaccattccagccaattctttctggtcaatctccttctcatcaaatgaaactaattccttactgtataaagcgtaaggactatctctaccaacaactcttgcagttcctccaaataacttaactttcacagttccagtaactctctcttgagttttgtctataaaagcatctaaatcctcccttaatggatcaaaccaaagtcctttataaattaactctccgtataaactatcaacgatctctttaaatctaagctcatcccttgttaaaactaactgctctaaagctttatgagcagttaataacaaaacagctccaggacattcatagttttctcttgattttaatcctatgattctatcctcaataatatctattcttccaacaccatgctttccagcaatctcattagctttctttattaactcaactggttctaatttttctccatttatagctactggaacgccctccttaaactcaatctcaacaatctcttcctctttatcttcaactgggtttttagtccatgcatatatctcttctggtggaacaaagtcagggttttctaactcactaccttcaatacttcttccccataagttttcatctatactgtattttttactttccgttgggattgggattcctttttctttagcatactcaatttcttcagcccttgttaggtttaagtccctaattggtgcaataattttcaaatgtggagctttaattcttatagttgtttcaaatctgaactggtcgttaccctttccagtgcatccatgagcaactgcctcagctccaacttcctcagctatttcaacaaccttatgagcaattaaaggtctcgctaatgctgttgataggggatagccttcatacattgcatttgcctttatagctctaaatatgtaatctttaacgaattcttcctttgcatctattgtgtagtgctttaaaactcctaattttttagctttctcttcaacttcttttatctcttcttctggctgtccaacatccacacagacagaaactaccttataaccatacttatcttccaataattttaagcaacagcttgtatccaatcctccagaatacgctaagacagctattctctccatgacaatccctcacaaaatatttttatatcttacataaaattataaatccttaaactttttgtattttattgcttatagttttggagtatatataactcacctattatatataaactgctaataataactgtcaataatcaatctaaatagaaatttttggggataaaatgacaaaagtagagaaaaatggcattggaaaaaggatatgtgtaattggtttgggttacattggtttgccaacggcttcaatgttagcaatacagggatttgatgttattggtgtggatataaatgaaaaaagagtgaaagaaattaaagaactgagctttaaaactacagaaaaagatttaatgactttagttaaaggggctataaactctggaaatctaaaagtgcaaacaaaacctgaaaaagcagatgtttttattatatgtgtgccaacaccttgcatagagtgtgatggagaaaaaaaatgtgatttaacctatttaaataaagctattgaaagcataaaaccatatcttgaaaatgggaatttaataataatagaaagcacgattcctccaggaacaactgatgatatttataaaaaattatcaaaggataagaaaatttatgttgctcactgcccagagagagttttgccaggcagtatattgaaggaacttgttgaaaatgatagagttattggaggagttgatgaaaaatctgctgaaatggcaaaagagatttatgaaacttttgttactggaaagatatatttaactgatgctaaaacagcagagatggttaagttaatggaaaatacttatagagatgttaatattgccttagccaacgaatttgcaaaaattgcagaggaaattggcattaatgtttgggaagcaatagaattagccaataaacatccaagagtaaatattttaaagccagggccaggagtaggtgggcattgtataagcatagacccgtggtttattgttgagaaatcaaagaacgctaaattaataagaactgcaagagagttaaacgactctatgccattatttgttgttgaaaagataaagaagattattaaaaaagatattggaaaagtggcaatatttggagtaacatataaaggaaatgtagatgacacaagggaaagtccagctgaaaaagtggttagtaaattgatagatgagggctttgaagttaaatgctatgataaatatgcgagagattttatttatcctttaaatagtttagatgaagctgttgaaggagctgatattatcgttatattagctgagcatgatgaatataaaaattttgataaagaagatataaaaaatatcgcctcaaaggtaaaaaataaaataatccttgatactaaaaatatattaaatagagagttgtgggaaaaggagggctttaaagtttatgtcttaggtgatggaaagaatgcataacctaaacaatgtctatctaaaagagtgcattcacttcttagatagctgtattaacgcactaaaagagtttgacttaagaacctttatatcgagattttactatgggatgttatatttgctaaatgcatttgaattctatattagagaaaacatagaagattggcacaataaagataggtatgcaaactttagcaaaaagattagaaacttcttaatggatttaaagctctataggcatgcatctgactatatattatctccaagattggagcatgggaagcactatgaggagcattgggaggagtttaaagagagttatttaaagctaaagtttttccattatttgcatatattgagacaggaactttatagttatagacacaatcagctaattgcaatcatcattgaaaagcttgagattattgaaaaactcttaaagctctatataatgttagaggaatgattatgaaagaactgataaagatattaaaacaatttggcatttatagtgaatatttaaaaattttagatgtggaacttgatggagatagatatatcaccatcttaatccccacaaccttaaactggattgaagaggaggagattgaggagatattagaggagatgttaaaaaatgtaagggttaaaatttcaagattgccattaaacaaattcattaagatttatttagagaagaatgttaaaaataaagcttatggagaaaatattgaaaatgttaaaatagaaggagaaaactatgcattatatattgattggaagaacaaaaaaatagttatccacaaatttaatggaaaaaatcctataaaagagagttgtaagctatcatcaaattgggaaacgatgtggggcatttgggttttagggtttgaaagtaaagagaaagctaaagaatttgctgaaaaccttgcagatgaaatctataaatattacgaaatagatttcgatattgaagagcataaaagatgtctagaagataattaatttctccaaatccattaaatcaagtgcttttagtttttcttttccttcaatactctttgctatgatgtagcactctttttctccatcaaaatcaactttatcaagttttctttccaaatcccttaaaatcccttttgcttctttaaagctcaaatccttccattttacttcaaaggcaatcatcttattattgttataagctaaaacatcaatctcttctcccttatgccaccacttagccacacttttttgaccaaaatcaataattttaagtttaagcatctcaaatacaaggttttcaaacattttaccatagtattcatttagagatgctaagattttgttataaacctccttcacattaccaatctctaaatctgccatgtttggatacacaacttgaaccacagattattaaaaaaaccttcgtatctgccaaaatcccatcccaaatcttttgaaatatgcttaaaactcctctatttaattgcattaggtattgaaattcatcaagtgctataacaaccttctcatccttaatctcatctctcaaatatctaaaaagatctaccaatccaacatccaagtttttaaaatattcctttccagttaagcttgaaaatactctctttaactcatttagattctcattcatggaatcgttggttagcaaaatatagatgccctttttatttttttattttcaagaaatttttttataagcatcgtttttccaactcttcttctcccatataggattattaagttggctttattctcattccactttctttcaagaaattcaagctcctcttttctattcacgaacataactatcccatacataatgctgttgataaagtataatacttagcctacatcatttatattgcatcaactatttataaataatgcgagtaataattctaaaaattaagaaaatctttatggtgatgattatgattaaagtggcagttacaggagctttaggaaggatgggaagcaatataattaaaaccataactcagcaagaagatatgaaagttgtttgtgcatttgaagttccaaatcatccaaaaaaaggagaggatgttggagagttaataggcattggtaaaattggagttccattatcaactgcagatgagttagataaggttttaaaagaaacaaagccagatgtattggttgattttaccatagcccatgcatgtgttgaaaatgttaaaatagctgctaaaaatggggttaatttagttattgggactactggatttactgaagagcaaaaggcagagattgaaaaagcaataaaagaaaataatgttgctgctgtaatatctcaaaattttgcaattggagttaatatatttttcaaaactttagagtttttagcaaagaaattaggggattatgatattgaaattatagagatgcatcatagatataaaaaggacgctccttcaggaactgctttgagagcagctgagattataaaagctaatagaggaattgaaagtgtatttgtttatgggagatatggaatgactggagagagaaagaaggaagagattgggattcatgctttaaggggcggggatgttgtaggagaccacacagttatatttgctggagatggagagaggattgagctaactcacagagcaagtagtaggcaagcgtttgttaatggagttatattggctataagatacattgctgataaaaaagaaggcatttataatacatttgacgttttgggattgaatgagattaagttttaaaaattctaaatcgtttattaaaaatttttatttctcccaaccaaaaattttaaataacaaaaaacttgtaatgataaataaagatataattgaggttatttttaaccctacctcagagtaggtagggtgtatatttttactgcaccccatagtgggtgcagtgcaacctattaaataaaaatttaaagattaagttattcaccatttgagttagattctgttttttcttctttagagctattttccaaatcctctccactataaactccccataaagctattaaagcagcaggaatagcatgttcagtagcaaatgtcatatgtggagctaaatctactatatagtcagcaaatctaaataatcctcttggaatcccctcccttgaaccacaaaatacaataatttctctcttttttcttaaatcataagctaatttatccttaatttttgataactcatctccttttgggtcagtaattattaacaatctattatctctcctcttatccctaacaacctgatataaatcttgaacagtcactggaactaacttaatttcaaatggataagctctcttttgaatctcatatcttgagtgctgcccaatcttaactcctttaataaattccatcaattcataggcatcaactttttcttttggtgctataattaactccttaacttcaaatccttgagctgctctcccaatagcttccccaaaccttttacaaacaattttttctcccaaatatggcatttgcacaataacaacttttttaaataactctctcgcatttcttttctccttggtatattttttgaacttttctccaggggttattgatacataagttttatttttaaatacttcaacatgaacaaccttatctggattatttaaatcaactgaagcatttgttaaatctttaatcttagctcccaaaacaatgtttatatctgttgagctgaaatcatgttttcctctttttttagtttctacagcaaaagtttcatcctcttttatgtaatctttaatcttttcagctaaattaactattttatcaaaatctgtttctgtttcaaaataaacttttaaaactctctcaacctctgggatttgtagtattttgtcttcaatatcttcatcactctcaactataacaataccttgataaccatcaggagaaacgatataattaaaatcatcaacaatttcttttagattattcacaacgatattttcaaaacctttttgagtttttattataaacttcatgattatccctctttaagtgttttatagttctttgtaaaatattttaggtaaaatattttagaatatattatgtatttaatgaacgccttcaataggaaggcgttcaaagttcatttataagctttaacagttttgcaaagactagttttgcatttatatacaatagtagagataaaactactaaaaatccatagttaatgcctatctcacagtaagccaataatagagaggcatatattgcatagagctttttatctccctcatatatatattttgatataactcccaacagcatagcaaataaacccccaaaaattccaaaatcaagatatatagttccaaataatgttgttgtaatgttatgaggatatttaaagagtaactcacctataaagtgctccccattaggggttaaagtaattttcccaagagttaatatattgctttcaacaatcttactaagaacatacaaatcaaaataagctctatagcataaaagttctattggatttaaatcccagttttgattagaagagagtaggataatttttcccataattcctaaaaagattaataaagcaaatgccaataaaaccatatatttaaataaaatgtttctatatctatatataatataggcaataaaaagcattaaaactcctgctttatatcccaataaaaccaaaatcataaacgcaattataaaataaactttattttcaatacctgcataaattaaagcccccatggatattaatcttaacggttctgaattaatagtcatccttacctcataattaaatagaggaatagccccgtaaatcaaaactattaaaagaaaagcaataattccaatagaaaataagatatcaacaaatatcttttttttataaaattttacgaaaagttctgcaattataagaataaatagcaaataagctatagataaaaacagcgaatgcgtaattttaaaagccccaaatattgataaaaaagatagtagaagaaatgaaagatacaaaatatgcctattaaatttaatttgcataggaaaaataaatggtaaaaaaaaccctacaataaaaattgataaaactcctaaaattttaaacaaagaatataatccaatatcatccaaatatggaaaagctaatataaaaatcattaaatgcccaattataacaatagataccggatgaaacaaatctatctttttaattttctcaataatattgcatatatgcatagtatcaacccaaagaaataatagaggattacatctatatccaaaatcccactttcaattcctataagcgtataggcaaacaatattccataaatccctaaataaatccctttaacatcttttgccaatttataaaagaaccctaaaaatatccctaatatcccaaagtatgggattatagccaaagtcccataatctccaataactgccccaactattgttggtgttatactcacattataaatccctaatgttttagctataacggttctcgctccattgcatagtccaagatatgaaaacactgccgaataatgaatataaccattaaaaacaccattaaagttgttgaatattatgtcatagatactcatagttaaagatattcttgatgtgattggatttccttcaacccccaaagcatacaatcttaatattgacaaccccaataaaataacaaagacaagaattccgtattttaaaatctctctgttagatattttatttttataatacagaattgctccaacagaaattaacaaaactaatacatttgtcctatatccaaggagcatgattagtattgaaaatataattgtatataacaagatttttttcttatcaatattggaagaagctactacaattgcccaacctaccaaaaagagatgagataatgttgtaaaataaacatttaaaaattttcttgacaatggattaaataaaggaacatctttaacccaaattaagtcagaggttactgctatcaatccaactatcattaaaaaaattccaaaattataatgcttctttaagtttatttttaaattctctttatctatgccaattaaataatataaccttttaccagcagtaaaagatatataaaagaatattgatgaaaataaaaaaactactgctgaatttattgaaatgtctgaaaatattaaataaatgcaagataacataacaaatacatgatgaagctcaatcttccccatattatcccaatgtaataatagcatagttttcctttattttattgggtatctcatctattgaattatttacaacaacatagatagttaattttgatgttgagatatttgaagagtttatatagttatcaagattttttaatgtattcaaatgaatttttccattaattataattccataatcaacaaaatataggcctaaaccttttttaatatcaacatcaagattattcataatcttttgtctttcaactggcgtatatgtttttgaatcaactcccatactaccctcaactataacatcaacaatattcaacccattaaagttttttgttgtgttttctatttcatttgcaatatctctgaatgactttccttctattgggtttaattcataaaatattattgactttccaataggatgcaatattattttttttgcagctatatcttcctgataagccaattctccaccaatagttattggtgttccattatatattgcatataacgttcccccttttgcatcgtatatcttaacctctccattgaaaggttttttagatagcgtccattttccaataatagtggcatttaaaggaaaatttttattcaaaattttctcacatacccatgcacatttatacatctggtttccatcaaactcataatcatttccattattactataaaatttatatgccaaggatacagaagttattaatatagacaatataacaactatttcgagtatgccaatttttttcataattatcaccagatcataaaactgttaataatttatgttagtaaaacttaaattaatgattgtcttaatgaatcttaaaattctaaaaattcttataaatagtatcggggacatcaatgaaagtggatttacacgttcattctatagtaagcaaatgttctttaaatccaaaaggtcttttagaaaaattttgtataaagaaaaatattgtcccagcgatttgtgaccataataaactaactaaactaaattttgcaatacctggggaggagatagcaacaaatagtggagaatttattggtctattcctaactgaagaaataccagcaaatttggatttatatgaagcattagatagagttagagagcagggagctttaatctaccttccacatccctttgatttaaatagaagaagaagtttagcaaaattcaacgtattagaagagagggagtttttaaagtatgttcatgttgttgaagtattcaacagtagatgtaggagtatagaaccaaacttaaaagctcttgaatatgctgaaaaatatgattttgcaatggcttttgggagtgacgcccattttatatgggaagttggaaacgcttatataaagtttagcgagctaaatatagaaaaaccagatgatttgtcaccaaaggagttcttaaatttattgaaaataaaaactgacgagctgttaaaagcaaaatccaacttactaaaaaatccatggaaaacaagatggcactatgggaagttaggaagcaagtataatatagcgttatatagcaaagttgtgaaaaatgttagaagaaaattaaacatctaattttatggttttcttttaagtctatagccacagtatggacagacgatccactcgggttgtacaggtcttttacagtttggacatcttaaaacctcttcctcctcttcttttagctttgcaccacagtgagcacagtatttccaagaatctgaaatataattattacagtttggacatctttctacttcttcttcaaatgtcatatttttaatctcagccccacagttagtacagtaagtccatcccaaatcaattggagatttacatgaattacagagaggnacaaatgttgaaaacttagttcccaaagctttcttaactttttcaagagttatcattgcttctcttcttagaatctcatcagggtcgtattcaattatctgatttagtaatgtgataatttcattcaacgttactttatcgtaagtatccaagtataaaattgcctctggtctaacttcagcaatctcctgtaactttctcaatgtcaccaattttgtagcaggaactgaacttctcaatcctgaaacaatactcattttttcttcatcagttaaaggaactacacgaaccattttccctcccccattaatagtttatccatttactggcaatctgtcattaatccaaaggtctcccaaagatatcagcttatctatataatataatgttgcagaaggtagttctttttctgaaacatttagaagtccagataactcagcatctcttctctttatcttaaatttgtagtatggctgaagccctccccctcctgcatagtagcatataatctgtacttcatcaacgtctgtattcttaaagacataatatgttattgctccaatatcttttttactatcggcatctaagctgtatgggctactcctcgcaccaatttctgtctttacttgatatactatagctgtttttacaccatttattgtcctattttcaatctttatcacatcatattctttgtatagaacgtcaggatatttctttggaaacactaccatacaaccacacaccatcaagctcactatggcaaataacataacccctcccagtagtttaagtcgtttcatttttatcccacttctttactacataatttattagaaataataatatcatgtttatagttaaagttatttataagttatacatgaagccataaaaacttaggttctgcaatgaggttgataatgatgaaggtttcagcatacgatttaaataaaatagcagaaaaactcaatttatccataaaagatttaaataaagcatttagtaggaaaattttaagagaggatgaatataaagaaataaaaacattactatttaaaaaagaatttaaagggatagagaaggggacagttatatttttaaacgacaaccttgatgttgttagagggtatccaaaaacatacagggctataactctctatcctacaataaaaaaacattttattgataaggttgttattgaagagaaattgaacggatataatataagaatcgttaaaatagatggagaggtttatgccttaacaagaagtggctacatctgcccatttacaacaaaaaaagttaaaaaattcttaaacttagagattttagatgactatagcgagtatatgttatgtggagaaatgattggcataaacaacccttacacaccttactattacaaagaggttgataggggctttgaaaatcttggattttatatatttgacataaaggagagggagacaaataaatccttaccaataaaagagagaataaacctatgtgaaaaatataatttgccttatgttaagccactggctgtagttgataaagatgaagctcatatacatgtaagggaaatcattgaaaagctaaacaaagaaggaagagaaggggttgttttaaaagacccagatatggctgtttcaccaataaaatacacaactcactatactcagtgtgaagatttaaaatcagcctttacctttttctttgatttaggaatggactttttattcagtagggttgtgagagagggatttatgagttatgagtttaaagaaactcttgaagagagaaagaatagggctaaagatttaggagaggcaattttattgccaatggttgaaacaattaataaagtagccagtggggagagggtttctgaagactttgagcttatatttgatagtgaagaggattttgatgagtttttagattttatgagaaagatgaaaatggttataacaataaaaaatattgaaaagattgatactgaggaaggtgttaaaattaaggcagtaattgggaaaatatacaataaaactaacgataaaattattagctatttaaatggaacactttgggaataacaaaatttaaatacctcataatgcttttaaagttttattaattttaaaagataacaaattatattgatatttaataaaaggtgatgaaccataaaaaggggattagtgtgaaaataaatacaaaagaattagtgttgaaaatatcccttccagctttggctgtagttatttgggaattgttggcaatatatataaataaccctgtcatactcccaagggttgaagcagttattaatgttttaattcatccatttcaaggaattttaggaactgggagtttgatagataatacaataattagtataaagagagtcataagtggttttttattagcttcagctgtagcaatacccttaggaatattgatgggctactatagaacagtaaatagcttatgtgacacattaatagaactgttaagaccaattccaccattagcttgggttcctctatcattggcatggtttggattaggagagatgtcaatgatatttatcatattcattggagcattcttcccaatattaataaacacaatatcgggagttaaaggagtccctactccattaattgaggcagctttaacattaggagctaaaggaagagatatcttaataaaggttgttatccccgcatcatccccaagtattttaactgggctgagagttggagcaggtatagcatggatgtgtgttgtcgctgctgagatgctaccatcaagtaatgctggtttaggatacctaattatgtatgcctattcattaagtagaatggacgttgttattgcctgtatgataattatcggattgattgggcttgtgttagatagaggactgagatatattgaagataaatactttgtttggagaaagatgatgaagtaaaaaaaagggataggatgaaggtaaagctaaaagtggaaaatctaacaaaaatttttgaatttaatgggaatagagttaaagcattagataatattaatttagaggtttatgagaatgaatttttaacagttatggggccaagtggttgtggaaaaacaacattattaagaattatagctggtttagattatccaactgaaggaaaagttttattagatgggaaagaagttaaaggccctggagctgatagaggagttgtatttcaacaatatacgctaatgccatggagaactgttttaaaaaatgttacatttggcttagagttaaaaggtatcccaaaaaatgaaagaatagagattgctaaaaaatttattaaaatggttggattggaaggatttgaagatgcctatccttatcaattaagtggagggatgcaacagagggtggctatagcaagaactttagcaaacgacccagagattgttttaatggatgagccgtttgctgcattagatgcccaaacaaggaatattttacagaatgaattattaaaaatatggcaaaaggagaaaaaaacagtgtttttcgtcacccatagcgttgatgaggcagtttatctttcagatagagttgttgttttaactgcaagacctggaagaataaaagagattgtaaaaattgatttggaaagaccaagagatagaacaagtatagaattccttgaatatagaaagaaaatactaaacatattgaaagatgaggtcttaaaatctctaaaataaaaataaaaaaggtttataagtttataataatctcataggtattcctctatcagcacagtatttttttatctcttctattgtatattctctatagtgcaatatccctgccattaatgcggcatctgcctttccataaacaaatgcctcataaacatgttctggttttccacaacctccacttgcaataacagggagtttaacacttttagaaatctcctttgtcaatatcaaatcatagccactttttgtcccatctttatcaatacttgtcaataaaatctctccagctcccaattcttcaacttttttagcccagtttatggcatctatacctgtttcttttctccctccgtatatataaacttcaaaccagcaataaccatcctctactttaacgacatttttatttatcttatctatctcatcttcattaacatagtgtcttttagcatcaattgcaacaacaacacattgagagccaaatatctcacttgcctctttaattaaatttggattttttactgcggcagtgtttatcgaaactttatcagccccggctctcagtattctcctaaaatcttcaattgacttaattcctccaccaacagttaatgggataaatactttttcagctgttctctctacaacatcaataattatgtccctcttttcagctgaggcggttatatctaaaaatacaagctcatcagctccttcatcatcatagtattgggctaactcaactgggtctccagcatccctcaaattcaaaaacttagttcctttaacaactcttccgtctttaatatctaagcatggaataattctctttgttagcatcctatccctatttttattatacttactttttattatatttcttattctaaataatcttcaaagtccttttcagatttttctacttcagttagttctgaaatagcttttgctaatcttaaggctcttaatgatgctaaatccttctctaaatagatactcgcgatttcattagctaatgcagtcatctcctttgtgaattttgttttaatttttactattggtgtgctttctacccactgcctttctacattttggtcgtagggtagaactccaataacatcatctattatctcactaatatcggtaagccctctatatttattcacaattatccctgtaagtcctatacccaaatctgttataagttctatagttttcagggaatttacaattgatgggatactatcctcaccaactacaactaccttattgacgagttcaaactcaccaacataacctatcaatgggttgtcttcagtaatgtttggtggaaaatcataaattatgacatcgtattcttcttctaattctttgactaaggtttcaaatctatttaagtcagatttatatccaaaaaccttagaagagacgtcagtatggataatagccaaatcatcataatgatatattatatcctcaattgcagaatcccctgcaaggtaagtatttaggttatgttccttatcttcaagaccaaataacactgcagtcgttcctccatatatatcacaatcaatcaatattgtttttactgactgactaagtatgtatgcaaaatttgcagcaacagtagtttttccagtacctccctgaatattgtaaaatcctattttcataatatcaccaaaaattttatttaagtggaattattttaggtggatttactatcacatatttacaatgttctttatcaaactcctcaaaggtatagttacccataccaaagttctttttaaagatggtgatttttatccctctgttgtcccatatctttatagcagttccattatagaagatattgtttctataatacttattaagccaatcagctaagtctttgaatgacactatatcagttccattctcttttaattcaacaaccaagtttgtattatagtttctaatatctgaaatatagattccgaagtcttcatcttttggtggaatatagagagtattaataacatttgctccataaacttcttttaaaggagatggaattctgatgacagggattccattaataacttcaaatcctttgtttcctggaattaccacataatcaactttattttttatatctaatttccaacttaggttttcattatcatttccaaaaattgcatctattaagtttttgtctgaactttctaagaataagccatcacagccatttgctaatgcataagcataatttttaacaaaccagtgattgaaatattcatatctattccacatttcactatcattttccattgaaactggctgcccttcataataccatttcgatggctcattagcttttccatcccaatatggctcgccttcatctaaatgataataaacattttcacttttagccccttcttcccaatatccataattttttgttcctttataacttataacctttggataataaccgccaatagggtcatttctaaatgtttctggtgctttatccacataaattagaggataatagcttaaagccaatatgtcttcaaaaccattaaawtcaatattttttaattgtgaaggattgaagtagagatgagtataattctgccaccattttttaaaccaataataattgtataaatcctcaagttcatctgtatctacattagatttttcaacaatatcaataccttcactaccagtcactatgtaacttacatttattcctaaagcttttaatgcttttatacattttaatttattgtttattatctcatcatccaacacatcaactttaatcttccttcctgcaacatctatagcataacttccactttcatctggaattactttatctatagctacccccgtagcaagcatatgcttataatacggtggaactttgtttatgtatgcaaaaacccctccatttttggctatatattctccaataatatcaagagttgatttgttgtttagagttgtaggatacagaaagagaagcttattctttttaatttcatagacaccctcatctattttcttataatcaattttataaattggggcttctttagcatccactggagggctaaatactaaaaccccatcattactcctaacaacatacttttttggatatattatgaaaatgccgttattatcaataaacacataatcgtaataatcggggatgcatttttctggaaggttgtaagagtatttataataatagttatcagaactgttttttggaggaatatagtatattcccccttcatctcctctaatgatgtatttttttggatagagaataaaggttgagttttctattaatacatatccaccatagtcaggaatttttgaaacatttggaaccttaattttatatggtcttacaaactcatatttactatagttttcttcctttggtgggttatatattaaagctccattttcctcataaacactatactttggataaactacaataaccccgtttatactaacataagaataatttccataatcagggatttctgatgggttatatctttttattccaagatggtataagatatctttatttatgttattactatcaagacagaagataactaaagcattggagtttaacaatctattgagttcatcaacattcttaatttcagatagtttaacaaattctattggaattgagcttgtatatttataatctaaatttgaggggtaagtatagctaattactgcaagtaacaaaactacgaaaataagttttttcatttactccacctcaatatcctttatctaatataagataattattaagtctttaaaataaatatttattcctcaaactttttgacatacattagaggatagtcaatttctgggatatattcaagttttaaatgagcaactgttttatttattttaatttttaaatcgacatctaacatctttccatctaaagagacatatttttccccaacatttctaatttttacctttatatcatatacacatggctgatttttcatagcttcctctatagctctttctaaagattccttattgtatttacttactggagtgcctacaaattggtgaaataaagctcctaaggtaatccccccttcaaacactgccctctctctatccgttagatttttaaaatattttttaaaaacttctgtttcttctactctcataatatcactatttattagtgtctttcaaaacttcttggataaccatttgcactaacgaacgtcttcctttggaaggcgttcaaaagttcattaataaatttttattttttgaaagacactaaattctaagcattctttcaatagctttttgagctttttcaataatctctttctctaatttaatttcatatctctcctctaataaacatttttctatcttctccaatgttattcttttcatctcgtggcaaatagcatctttcctcaatggaattaaggttttctttttacccaatttttcaagctctatctccaatctatttatcattccaacttcagtgccaattataaactcttcatcatctgactctaaaacaatcctcaatattccacttgtgcttgctatgtaatcagcattatcttgcaattctggactacattctggatgaattaaaactttagcatttggatatttgcttttaactctctttaaatcatctattgtgaattttttatgcacataacaacctcccccttcaggaatagctataacttttttatcagttcttttttgcacataataagctaagttgttatccggaccaaataaaactgtatcagcatccaaggaattaactactctatctgcatttgctgatgtgcatgtaatatcagctaatgcttttgtctctgctgttgtattcacataaacaaccaatggagcctctggataaagctctctatacttctttataatctctgggggtagttggtgagccattgggcattgggttccttcaatctctggcatcaaaacttttttctctggattcaaaatttttgctgactctcccataaaatctactccacaaaatactattatgtcagcatctgtttcttttgcctttatacacaactctaatgaatctccaagaaaatcagctattttctgtatctcctttggttgataattgtgagccaatattactgcatttttttcttcttttaatttgtttattctttctactatatccatagacatccctcaaaaaattatattttatattcggtgtttttctaatctctcaacaaccttatcccatgttggtaaattagtttggcatccctttgcctcaacaacaaatgaggcagttgcagcaccaattaaaccacatttctctaaatcataccctttgacataggcagataaaaatccagctctatagctgtctccagcacctgttgggtctataactttccctgctttaatacaaggaatttctatttttttatctttagtgtatattacactacccttagaaccttttgttactataagggcatcaaccctctctaaataatcatcaatttcaaaatttaataaattagatgctctctcaaattcatgtttattcataaataaaaagtttgtatgctcaataatttccaacaacatttcttttgagtattgaggtaagtcctgtccggggtcgaaagagaccaaattgtttccataagctttttttgcacattttaagttgaactctgggtctccagtggctatatggacaatttctgtattgaagtttggtgggtttagttccttataatgcttagcagctccccataaaaagaaagttatctgattgttatccttgtctgtaaatatccatgcctttggtgtttcttcttcttcagaatagtaaagtttagaaatatttatatccaaattctttaaatacctctcatatccactatttttaaaatcatagccaacacatgataaaagctctgaattaacaccaagtttttttattcccactgctgtatttgccgctgctccaccataatactttctcgccgaaggaatttgaattgaagtattcggttctggaaatttttctacattgaagatataatcaagggcagtatgccctacacatgtaatcttctccattttaccacccaaaatttttaagaataacttaatgatttgaataaattgaacattaagtattagaacaataactgtttgaaccctttatatagtagattagcaaaaattgtttatatagagtaactttaaagttaaaattattgaactactacttaaagatttttaggtgaaaattatgataaccatatctgaaaattctgaagcaaaggaattaatgcctattgctcaggctgtccatatattggttaataaactccctgttgctatgagaagcaaaaacaagcctggagttaggttggaaaaaggggaggttgtagatacgaattacgaaggttatgttttaaaagtagctattgaaaaaggtgaagttgttagagctacacctattataggcccttatgcaggacttcctgttatagtggctccaataaaagatggagataatgttttaggagctattggtgtagttgatataacagctggaatatttgaagatattgtggctatttcaagaagacctgaattatacaaatttttaccagaagatgcatttccaaaataaaaaatgttaattattaatacttcgcaaaaatattggacattaattggggctgaaaagccccaacttgatggacgtgtggtatagcaataggaggtatcctcctatgcttgtataagtttttaccagaagatgcatttccaaaataataattatatcccttttatgcttgtaaaataaacttttaaggtgatagaatgaaaaaaatattcatatacccaccaaatagcttaattctaacagatttggttgagagatttggacacaagcctttaaacttgaatatagttataggaaaattagtcagaaatcctgaaatagacagcccaccaatgaatataacagacgaagagcctaagaaaggtttgaagtatgcggctgtggaagttccttctggtgttagaggaaggatggctttaattgggccattaattgaagaggcagaggcagcgataataatggatgatgcaccaatagcctttggatgtattggctgccaaagaacaaatgaactaactctatatttagttagaaggaaaaatatcccaatattaagagttaaatatccaacaaatgaagaagaggcggaaattttagttaataagatagcaaacttcttaaagagcttagaagaaaatcaagaaaattaaaaatttggtgataagatggaatgtccaaataaagaaatcaacttaaaaagatgcaactgtagttacccagcttgttctaaaaaaggaatgtgttgtgaatgcttacattaccatttaaaaaatagacagttgccagcatgctgttttccagatgatgtagaaaaaacttatgacaggagttttgaaacatttgcaaagcttgttttagaagggaagatttaaaaataataaataaatttattatttttttattttatagaaatttactcaacaattgctgatgcgtaaccaacaactgctgaataatctccagttatatctccagatgtcgcataagccaataatttagctttttcagctcctaaggtcttcatggcttttaacatagctattactggcccatatccgcacattgagatgttgtaatttacaacatcctcatacaattctttttcattcatctctaaaatatctttaataacaattgcatccttttttgaagcaatttcctgtggttcatagtgagttaaatcggaggaagcaattacaacaattcttctgttcaattccttagcaattttagctatgaaataaccaacttctacagctgtctcataatcttgaaacatcatacatattgggactattttaaatttagcaatatttaacagctctaaatgctttaagaatggtaattggacctcaatagaatgttcatttagatgggcagtttcatctaaatcaactatctcacatttcctccaaagctcctcaacaaattcttcatcacacttcacatctcccaaaggagttctccaaattccgtccattacactaactcctgaacctaacccagtatgattgggccctaaaataacaacagttgtttcttcaagggcatcaactctctttgataactcataataagagtgggcttgtataggtcctgaataaacatagccagcatgaggacagagcaaacctataggtttttcataagttccatgaactggcattgactttggtccaaatttgtgtaaatagcactgctcaatcatatctatgagttcatcaggatgtgaaggataaaataatcctgcaactgctggatacctaattttattcataatacccctctaataaattgtttaaaacattaaacctaatttaaaattgtcatttattctttatatagttatttgtgtatgtatatgacactataatgcacaaaaccgaaaagtttttatatttttacacatatgtgtattattagaaaaaaatgattagaaaatatgaggtgataatatgtttggatggggaagaggatggtttggcagaggtagaggattttggagatacttcccagttagcacagttggaggcagatacagatacgtagggccatgcagatgtggtttagggccacatgcattctatgttgatgagaaaactggggctttagttcatgcatgggatttatacagaggctatgttccaggatacgcagaggtagatgaaagaagatacttagaagaaactataaaagaattagaagaagagaaaagaatgttagaagaagaattagcaagaattaaaaagagattagacgaattaaagaaagattaagtgatataatggaaatgaaaagatttttatgtgcaaaatgtcagaaagttatagaagttccttatggagttccaaaaccagacgtttgtccatactgtggagctcctgcaacatttattcacagaatagatgctgggggaagaggattaggccctgggagaggtagaagatgcggaatgagaatgatgggaagatttagaagagaataaatcaaaatttttaaatttcttttttattttttatatttaagtatttaaatatatttatctaaaaataaaaaattaaaataaaaaggataaaaataaaggaatttatttcttcctaatctcttttaacgcctcctcaacgtctgcattttcatggactatcttacaaacagctcttgttatgccaacaacatcatcatgctggaagatatttctacccactgcaacaccagcagctccagcctccatagcatctttaatcatttgcaagaactcttcatctgtgtttgtctttggccctccagcaaccacaactggagctggacaacccttaacaacatctctaaatgaatcaatatctccagtataacttgttttaactatgtcagctcctaactcagctcccaatcttgctgcatgagcaactaattcagggtctctctcattttgaatgtgttttcctcttggatacatcatagcaattaacggcattccccagtattcacatgtttcagctatcatccccaaatctctgtatgcttcccaatcttcatctgaaccaacatttacgtgaattgagacagcatcagcacccattctgatagcttcttcaacagttgtaacaataaccttcttcaatggatttggtgatattgcagttccaccagagagatggatgattaaaccaacatctttgccatatcctctgtgtccatgtcttacaattcccttatgtaagaggacagcattagctcctccttcggcaacatcatttacggtttttcttatatctataagccccttaattggaccgtttgataccccatggtccattggaacaattacagttttttcactttctctgttaaatattctctccaaccttacaagttttccaagattctttatgtctttaaataattccatattctcacatttacaaatttttattgttttatttgatattaatgttaaagttttaatatagaaatatcagatatcaatatttaaaatttgtgtttggtgatttgatggtatttaaagcctatgatattagaggaatctatggtagagagttagatgagaactttgcctattccttaggaaagtgcattggtaaaaaatttgaaaataaaaagatattagttggaaatgacgttagaattggttccaaagagcttttaccctattttatagttggtttgaaagaatatgcggatgtattttatgccggaactatttcaacccctttaatgtatttcggaactaaaggaaaatatgatttaggagttatattaacagcatctcataaccctccagaatacactggatttaagatgtgtgataaagaagctattcctctgtcaccaatagaagagataaaaccaatattcaaaaaatatgaattaacagaaagtataaaagaagaagctaaaaacctaaatttagatgatttaaaggttaatattatagaggagtataaaaaattctttttaaagagatgtaaagcctcagataaaaaaatagctgtagattttgcaaatggagctactacaatagctgaaaaagaaattttgaatgaattgtttgataacgcagtttttataaatgattatcccgatggcaatttccctgctcatcaaccagacacactaaaaatggaatgcttaaaagatattataagagcagttaaaaaaaataactgtgaattaggtttaatatttgacggagatggagataggttgggaatagttgatgaaaacggaaatgttttgaggggagatatattaacagccataatagcaaaagaaattttaaaagaaaagtcaaatgccaaaattgtttatgatttaagatgttctaaaatagttccagaaattattgagaagtatggtggcatagcaataaaaagtagagtggggcattactttataaaaaaattaatgcatgaaatagatgctgaatttgctggagagttgagtaatcacttttactttaaagagattggctactttgaaagtccattactggcgttaaattatatcttaaaagctatggatgaagaaaataaatcattatctgaactaaataaggaatttagcaaatatcctcatagtggagagataaactttagagttaaagaccaaaaatatattatggaaaaaataaaggaacattttaaagattgcaagttagaggagttggatggaatatctatttattgtaaaaacttctggtttaatttaagaccttcaaatactgaaccattattaagattaaacttagaagcagatgatgagaaaacaatgaaagagaaggttgaagagattaaaaatctaattgcaaagcttgatgcatccttataattcatttttatggttgtgtctttaatatacacacaaccaaaacctttatatattagtttgtagttatagtaatttcgcttgttttggattaaaagttgagtgaagcggggtagggtagccaggtccatcccgccgggctcataacccggagatcggaggttcaaatcctccccccgctactatttctatattttgatatattatatttgtatatttaaatgtaagaattaatgtttatccatagattccaagagtttttggagtctttctcgttttctttttatagagaaactgacttttatagcaaagttcctaacagattcttttctatggattgacaatctataaaaatcgtctttataatggtaaatttcacctctaatatttgattcagttccttttttctttgctatgtggattgttgaatgtacatccaacttttttaacagctcttttgaaaattccaaaagttctaaatcataattttctaatgctattttatttgaagtaacatatccttcgctatcaaaaaatcctcttaaaaaatcttcaggatacttttcagcaactttaaaaagttcttctttgttttgacttaaaaatttatacaaacttttactgctcgcttcaacatgccacctattacttcttgttttctcttccacatagctaattgttggatttaatccaatttttatcaaactatttttaacaacatctacaaagtctttatcaacaaccttaatcctaaaatagtaacttcctgtcttttttctgtaataaatgttagcatctccaaaataaacccctattatataagaaagctcaggagaaggtgataaatctataaattttgttttattgaatggattattgctatttttacaccatctaataatcgtagatttggaaattttaatattcctttcaatttcaatctttttagatatttgagaatagctaaaattttgcttccttaatgatttaacataatttataagttccaatacttcattttgggagagttctttaagattaaccatattatcaacaaaataataagataagtatttaagaaagtatccatcatatcattctgtttccaattttcatgtcttactgtagcattatttataaaataacatttatggttattagttattttattaatttaaataaatagatatatacttttatgatataatgatgctccggccgggatttgaacccgggtcgcgggctcgaaaggcccgcatgattggccggactacaccaccggagcaatcggataaaaaatagaaaaattggcggacccgaggggatttgaacccccgacccccggcttagaaggccggtgccctatccaggctaggctacgggtcctctttatctcaggttgtaagcactctttaaaatgaattttctcatatatatacttttcgtttcataacttataacaatttttgtatggttaattataaatataggtttgtggcaaaattaataattacattaattatttattgttttttataatctcactaatatgacgattagttactctttttttattaaatttaactgattcagaggtgaatatcttatgtataaaattttagagattgcagatgttgtaaaagttccaccagaagagtttggtaaggatttaaaagagacagtaaaaaaaattctcatggaaaaatatgaaggaagattagataaagatgttggatttgttttatccattgtagatgtaaaagacattggagaaggtaaagtagtgcatggtgatggttcagcatatcatccagttgtatttgagactctcgtttatatcccagagatgtatgaacttattgagggagaggtcgttgatgttgttgagtttggtagctttgtaaggttgggacctttagatggattaattcatgtttcacagattatggatgactatgtatcttacgaccctaagagggaggcaattattggaaaagagactggaaaggttttggagattggagattatgttagggcaaggattgttgctataagtttgaaggcagaaagaaagagaggtagtaagatagcattaaccatgagacagccatacttgggaaaattagagtggattgaggaggaaaaagctaaaaagcaaaatcaagaataaggtgagcttatgagagcatgtttaaaatgtaaatacttaacaaatgatgaaatatgtccaatatgccactctccaacaagtgaaaactggatagggcttttaatagttataaatccagagaaatcagagattgctaaaaaggcaggaatagatattaaaggaaagtatgcattaagtgtgaaagagtagaggaattgatatgctggtgcttccagaggagttgagggaaaaattaaaaaagccctttggaaaagtatataaaacactaccagatatagatggagatatcgtaactgttggagatattgtaacaaaaactgcaattgaaaacaacataatcccaaaactatccatttttgacttaaaaaccagaagaaatattcctgttaaaataaaccatgtatttaaaaaagttattaaagtaaaaaatcctcctggatgcatatctgatgaagcaatagaaagtattaaatatctatctacaataaatgatagaaacatcgccctactggttgatggtgaagaagatttacttgctttaattgttatcaaatactttcctatcggaacttatgttctatatggacagccagatgaaggaatcgttgttctaaaaataaataaaaaactaaaacaagaaattgaagaaatattaaaacaattcaaaaaaatttgagagaggggataatatggaaataaaaatattatcagaaagatacaatccattgttaaagagaaaagaatacagattcattgtagaccacgatggacctacaccaaccttcaaagatgtcaagttaaagcttgcagcaatattaaacgcaaataaggatttattaatagttgaaaaaattgttgaagaagctggaatgcagagagcaagaggttatgctaaattgtatgataatgaggaaatgttaaaattagttgagagagaacacattttaagaaaaaataaaatagaagaagaaacagcagctgaggagggagaataatgacaaaagggaaaaaaacagcaaaatacaaatactacaagattgaaggagataaagttattagattgaagaagacctgtccaagatgtggtcctggagttttcatggctgagcacttaaacagatacgcatgtggaaaatgtggctacatggaatggaagcaaccacaaaagaaggagtaagttaatcttttagctcttcttttaactccaatatactcatagccctcaagatatctgtttttgatatgattccttttaattttccaccttctacaacaaatactctatctgtattagccatttttcttagaatctcttttatatcagtatcttcactaactacaacaggcttttccatataatcccttacagttccttcttttttatgtatattacctattccaatacagccaactaacttcccattttcaactacaggatatccaaaatacttatgtttaagcataaaatccaagaactcctctatactcatatctggagttacatatactggatttggcgtcataatgtcctttgccttaatatttttaaatattgtctcaacttctaccactctactttcttgctcagctccaaaataaacaaacaaactaaccaagattaatataatgttcattgataagagaccaaataagagcattattaaagccaagctctttccaatatttgctgctatcttcgttgatttcaaataaccatatttttttgacaatatagctctcaatattcttccgccatccataggaaatgctggaattaaattaaatcctccaagcattaagttcagtaggcttaaagtatataatagaggatatccatttatgtttatatcaaaaaattgagatacaattaacaaaactattccaataataaagctaactaaaggcccagctatccctatccttaactccccctcttttgggattttatccatcatcgccactccaccaatcggcaatagcaaaattttttctatctttaccccatacttcttagctacataactatgacctaactcatgtaaaacaacagacacaaataataagataaagagaactgcccaaaatatgctattattcattatagacagtccaattatgaccactaaaaataaaataaaggttatatgaagctctattggaatccccataattttgaataatcttattgagtaattcatacccctccccctatttttattttaattacatttttaatcctattgctatatattactatttcataacatatttatgattcggtgaaatatatgattccagatgaagaatttataagaagagaaggagttccaataacaaaagaagaaattagggctgtgagtattgggaaattaaacttaaataaagatgacgttgttgttgatgttggttgtggaagtggaggaatgacagttgagatagcaaagagatgcaagtttgtttatgctatagattatttagatggcgctattgaagtaactaaacaaaatttagccaaatttaatattaaaaattgccaaataataaagggaagggcagaagatgttttagataaattagaatttaataaagcttttataggtgggacaaaaaatattgaaaagataattgaaattttggataaaaagaaaataaatcacattgttgctaacacaattgttttagaaaatgctgctaaaataataaatgaatttgagagtagaggttacaatgttgatgccgttaatgtttttatttcttatgctaaaaaaatcccttctggacacatgtttttggcaaagaatccaataactataataaaagcagttaggtagataatcatggaagagaaaataatcctatcaatccaaaacccagaagatgttttaatttcttatgttgatatttacttaggagataaaaatgtttcattggaggttttatctaaggatactgcaaagataaatctaccatttgataaagatgaaggagagggggagattgtagttaaaattaaatataaaactcttccacactacaaaaataataataataaaaaggaagttaaaaaacaagattataaaaatttaacacaaactcttaatgaaatcactaaaaaaactactaatagaaaagataatgatattattatagctgactctaaaccagtttcattagatgggcttaaaaaagaagagaaaaagaaaaagttaaatgatataataattgtctaattttataattataatctctttctaattggctctaaaatctttataagttcttcagctacagcattttttaaatccattggatgcaattccttatttttaaataaactctctaactcctcatagctattaactgtcaaatctccaccaaatttttctggcctttttatggttaaaggatattcaaggaagtatttagctatctccattattggatttccttcaacaactccagctgggcagtatgctttctttatcttagccctaatctcttctggagagtcatcaacagctataaaattcccttttgaagaactcatctttccttctccatccaaacccgttaagacagggttgtgaatacaaacaaccttttttggtaaaagctcccttgctaacatgtgtatttttctctgctccatccctccaactgcaacatcaacgcctaaataatgaatatcattaacctgcattattggatagataacttcagcaacctttggattttcatcctctcttgctataagttccatactccttcttgctctttttaaggtagtttttaaagccaatctatagacattcagtgtataatccttatcaagctggaattcacttccataaacatattttgcctttaaccccattgcttcaaaaacttttttgttataatctcctatttttctaatctcatccaactctcctttctggtttaaataggcgtgtaaatcagccaacaatataattatatcaaatccagcattttgtaaatcaatcatcttttttatttggagataatgccctaaatgtattttaccacttggttcaaaacctatgtaagcagatttttcatctttttttaaaacctctcttaactcttcctcgctgataatttcagatgtgtttctctttatcatttcaaattcgtccatgatatatcaccacaacatttttgttcatgcaaaactttattatataagctatggtaatttataaatttactttattattttggtgatactatgagaaagattatttcatcaaaagtgagttgtgatgaagagcttttggagctttgtgagagattatcaaggatggacattgattgcacaatagaatcaaaaggaaatagagttagagtttatgtatttggttatgataaggactctttgaaagrgaattatagaacaattagggaagttatggaaaaagtcaagagaaaatatcaaaaagatgatgaagggttgtataaatatccattatttgaattaaaatatccagttaataaaaacttaataatagatgcactaaaaactttaggatataaagttatatacttggaagatgaaaacgctataaaaacaaatgtagatattaacaaattcaatgaaatattgggagaactccacgaattatctcaagagttaagattttcaaatcttgggtcaaagcccgttaaaaatttagtagttttagtttcatacattactaaaaagccagttgatgatgttattgaggaagctttagaaaaaggattctttagagaggaagaaggtagaatagttttaaataaggatataaacttggctaaaaaagctttattggagggagaagatggagataaagatattggagaggaaagataatttggtagagattgaactaattaatgaagaccattcattaccaaatctattaaaagacattttattaacaaaagaaggagttaagatggcatcctactctatagaccatccattattacatccagaaactggaaggtatatatcaaacccaaagataactataattactgaagagggaacagaccctttagaagttttaaaggaagggttgagagatattattaaaatgtgcgatactttactggacgaactaaaggaaaagaagtaatttgaatagtatcacgttaaaagattttatatttggaattaatttctttaactcttttcttaacttatttaatagaagtttaaatttgatttctaagggtggcttattttaaacattttattaatttggatgtattaaattatttaggtttttgggagtaagggctaaatacatttaggagtaagatttccccaataaataacaaacactttcaaatttaaagtgataaaaatgattatttttattaaagaaataagaatttaactaccataaggtttatattgcaaaacggttatttatccttaagaaattatggtatagaaaagcttaaatatcaggagagttaaggtataatatattgaaaangtccccctgtaaaatcagatccctcggggaatggaaattgctcctcaaaatgtacaaaatactcagattaaatcgtaaaatcagatccctcggggaatggaaatcaaatattaccctataacctcttttacctctattgtgtaaaatcagatccctcggggaatggaaatacaaatcaacataaaaataacttcaataaaagttgagttaagtaaaatcagatccctcggggaatggaaatttattcattttgggaactgtattatctctattattatgtaaaatcagatccctcggggaatggaaatttctacaactttaacacttacataaataactctctcatcgtaaaatcagatccctcggggaatggaaataatccactacctaatcccatatcagctggtaatccacgtaaaatcagatccctcggggaatggaaatgaagggaggactttcccctgaacaattggaaaaatagtaaaatcagatccctcggggaatggaaataatgcttacactgatgaaccagatggggaagagcaatatggtaaaatcagatccctcggggaatggaaataccgtattaaaatacatacaacaaatagaagatgacgtaaaatcagatccctcagggaatggaaatcttaaataagattttttatcttatttttttttattgaatgtaaaatcagatccctcggggaatggaaataaatcgacatcttggacaattttatgagcttcaactccgtaaaatcagatccctcagggaatggaaacaacagatgaatagggagaagggaatggaaactcattagaagataatcaatgttaaaaaaagaatgggactatgtaaataaaatcttgaagaaaattaaaaatataagaaaccttcttcaagatgagagtatgtatgttattattgtctatgatgtgaatgtttcaagagtaaataagataaaaagctttttgagaaagcacttaaattgggttcagaatagtgtttttgagggagaagttacaaaggcagagtttgaaagaataaaagatggaattttgagaattattgatgaagatgaagattcagtaattatctaccaatttccattaaattttatgccaaaaagagagattttaggtttagaaaagaatccaattgatgatattatttaataaaaatttccaaaccattccaaaatactctgaataattagaggagatattcttacactttttaactttcttatagctgaatatactgcatctaagtcatcataaagaataccatctatgaaggttagggaaacttctaaatcacctctaagtatgttatctacaaactggattgtattatagaaatcagtagcttttaaataccataaaaagtccataagttttgataaatcatactctccaaaagatcgtattgcttgattgttatcaacattctcgagagtgtaactaacaactgaaaaattcttttttgtaactatttccaaggcacttattgattcagtatgggttaaatgatatagcagtgccaattttttatttacaaaaaatttatattttccaagttgatagttgttaattttcttttttaaatcttttaaagcaaggatttcaataagtcctaattcttcaagaggttttatggcataaatatgaatatatgttgctctattgtctgatatatttatgtatggagcataataatggaaaccaatccaggcaagggcatagttggaatcatctatttttattggatttccaccttttacaccataaatttttggcatatatttaccagcagctggcattaaagtaagtggcactgtatttttactctttgtagataattttccttttttaatattttcttttatcttttcaagagtttttggaattccatcccaataaacgttattaatatttgcacctgcactaaaatcaacatcacttataattttgatatcctcctttgtggaaatatacttaccaatagctttatgcagggaaagcatatcctccaatgcatttaacattcccttttcaattctatttttaatatttacattagtaggttcttcaactacaatacaatatttattcccaattgggaaaaatctgagattttcaacgccttctctaactaaacactcaactactccataagctatatataaatcaagtatctcattatatcctggtgtctcaaataacataactctcaacctccaaaacttctgcaaactttggagcttttccttctctactctcagcccctttataatcacacatgactaaaggtaaaagcagagttccaacaataaatctaagcttctctgaatttggtgtatgtcttgctctaacactcatttcgataacaaatctgataatatcgtccttattagaatcatttttaattatatcccctattgaatatccaattaactttttaataagatcttcaaaatcttcaatcattccatcaaacttttttagcttatcaagcacgacttcagctgtcaattctttctttttaagatttcttatttgacccataataatcggctcatggtggagcattacagttaaagctccaatgaaggcaaggtttttatcaccaaattttttaaggagaatgtgataagtatagtaagcactaacaagctcatgtctaaagcccatgagtttttcttgatcgttaatgatagctctttgatatatctttgaagctttaccaatatcgtgaagttttatcaaaatcttcataaattcatcaactttttcgatatctaactttatgtttaaagcctctaaagctctctttatagtttttaagtatctatattttattctctcccaatatttgaccatatcgttaacatgatcaataagggattgatttttaaaggctaaaacttccataatctcacccaaaatcaaagtttgttaaattattatcccagtttctttagagtaatatttgtcatcaattatgtagattttgtaaggttgtagttttccagcttttttaagactacatatccaacctttctcatcgtattctttaattaactcaaattttttatcaaacttctcccacttgtttttaagccagttatagctcacacgaataacatattttggattaaactcaattatttctttattttttactttttcttcagcattttctaatggatacaatattgcaaacatttctggtcttgccttgagttcatattctggaggtgtagaaaagagttttaactctctgaaatatatgtaggcagagtaatagtctttagggactatgttgttttcataatattccttataaaccctatctaaagcctcacgagctttaattatgtcgtataaatattcactaacactttcaacttcatcaaagctttttatcataattaatggatcatagggctgtgttgaatatggaataaagtatagatcttttttcttcagaattttgttattttcaataagctttcttattgtcttgtttcccaaatcaccgatgtaaaactttttagggacgattttgctctttccttttttctcttcaattgtttcaatagttaattcaataactctcccataatctttgttatttaccagtgttacataggcattttcaaatgggatatttttaaatcctaaaattactttttccctatggtcttcatttattttctcattaaaatttggcaatacaactattactttgcctctttctccttttcttcttgcacatcttcctattctttgtattaatgcatctaatggagctaaatcagttattacaagccctacatttgtcaaatccaaacctgcttcaaccacctgtgtagcaacaattatctcggctttatcaatgtctttctctttttctgctctatcttctactgtaaatcttgagtgtaggagtaatgaatttccaagttgctttactttttcataaacctctatggcactgtttacagtgttttttattatcaacaccttttttccttcatttattgcttttttgatttcattactaagttcttcgtcacttaatttttccttaaattcaacaactacttctcctctctctggttttttcgtatcttctggattaacggttattggttcttcatcgtgtatgccaagtatttttttaagctctgttggaagtgtcgctgtcataaagactaatggaacgttagcttctaccaatcttttaactaccaatccaatcaatctcggcatgtaaaggctttcatcctgatacatctgtatttcatcaaaaactactaaactttgagcaattgccccacatgggaaggtaaatctatctccaacagtcctatgggctgctaacccataaagaaatgtatcccaagtagttaaaacaacaaaccctaagaaagcatgggtttcctctaatccatactcaacttgaactatttttttagctaattcctcaactttatcctttgaatatccttttatttcaagaatttttttaatataattcctgattctttctacctgtttttcaacaagtgaacgtgtcggaagaacatagattaatcttggaactttccaatcgttggagatgaattgatataagtagggaataattgctgcttctgtttttccaccagcagttggtatctctattactaccctccccccaagttccataattttattaatcttttcccatgccctaatttgataatcataaggctcatgatctgtaatttgtttaaaaaaattaattatatccataacccaatcacctcatcaaaggcaataattttgtaatttccgtcaaaaattctatctgattcaacgtaatatgagcttcttctataacgtttttcaataagtggtagtaaatacggctcttcttttactttatttccaaaatttggagtttcaagcatattttcaataatacctccatttatgctcatttttgatacttttttaaacttcacataggtttttagaggagctttttcttcttttacttcaacccattcagttttaatcacatttcccacacactcagtatctccgagctggtcaattaaataaactgccttaagcattagatctttttcttcttcactcaactttctcctaaaaacataaatagctaaaatctcccttgcaaatacatattctcttctcattgcgtcacttttttctggatttttttgatcttctaagtttctaagtctctttagtagaattggggtttttatgatactacttttgtatggctttgctccgacatagatgagcttattttccaattcttcaacagtttttttagcaatttcatctaaactctttcctttttttccaccaagcaatataattcccttagctaatgccccttttaatgctgatggagatggtaatagcaaagattgtctaacttgataagactgttttccaaaagaatagaatggaaatcggaggagagctactaaagcctccataatcaacccctcaatttataatttctctattatttttgagattagctcttcaactgatgaaacgctctcaccaaaatctacattgtatccgaaatcctcaatctcaaatccaagtttctttgcattttctacaacgtttttgcttacttctacataatcctcatagaatccatgaactaaggcaggtattggtttttcactaacaaccgctatcatttcttcaagtttaaatactgggaatgacctggctaaatttgctccaatataaccacttagcattggaatcaaagcttttaatgccgatactattcttgcttttctttcatcatcttcaataactggatttgatggagatgattgaggaactccaacaaatcccaaatctaatatgatttcaaatccatacagcccagttgcatactctctattaaataacatttgggcagtttgttcttctccagattttattgctcctttttcatcaatatcaactctattatgctttacagcataaacgagcctttcatctacttcttttatgaaatcttctgttgggagtataaatgaggtttttacaagagaaactcttctaactccagtttttggagctagaaatccatgaacatctgcatcagcaaagtttttaatgatttcactttcatccttcaattcaacttcagaaccatcagcttttttggctttagtttcctgtccaaaccttgccccattatatctcaaagccctttctgttaaattatctttgtaatctgtctctctaaagaaatcaacaaagcttacaaaatgccaatgcttaaccatatttccagaaattgctggcacttcaaggatttcccatctatcatcattctttatgctaaccttagcttttgttatctccacataatttgttcctcccccaccttgggcatttaaagaatgggaattcaacctaactcttcctgagattctcaagaacattactgatcacctctttttctgtggtctttttcccagtctgcaaaagcccagagtgccatgcttaatccaatttttctaacttccttttcattatctccgatttctctcaaagtttcttccaacttttttacgtcctctggagatgggacttcaatatttcctttcttttttagttttggggacaatcttaatcctttatataacgcttctaaaagttcatttgcatttcttgctttagctactccatcaatgatgtcataagcatattcctcaaacttatcgcttataaggtagctaagatatcttccaatatttttcatccaattctccaactttatcacctcatctattgacactacataatattaatatgggaaaatataaactttactaaggaatttcgtagaagtatacaaagtatttatatattacttcgaagtaaaatatatacataagaagtatttttggtgaggtatatgagatatatagccacctttggataccatacaaaccatatttttgataaaaatgggaaaataattggaatagatgacgaaaaaattagtaacatgattttaatatacagtttagatgtagatgcagatgaaaatacagtaaattcgattaaaaacacaaaaaattatattgagtcaaaactaaaagaatataacatcccttatctatttgttgaagttaatccttacgaatttaatacgaatgttaaaaattttagaaaatacattgttcctaaaactatcatcaatttaacaggtggaaaaagaatagtaggatatgcattattttatgccgcagtacttgaaaaagaaaatgtagagaaagtgttttatgtatcaaaacttggagatatcattgaatttccattaattcctccagacataaaattaacagaacttgaaatgaaaattcttaatttattagataaagaaggagaaatgtccgtaagtaatattgcacataaattagaaagatccctatctactataagtgaatatgtttcacaacttgaaaaaaagggtttagttaaaaaactaagcaaaggtagaagaaaaattgttaaaaaggttatctaaaaccatgcaactaacggctcatatctcttctgcccaaccaagtgtttaaccaacttataagcctctaatcttatcaatctcctctttgagacattcttttttagttttttatgattaactgttttatccatctccttgttgaagtgttctaaaactactttcatcccttctttgtttagtagaactccatttaaatcatctctaaaatgctttttctggataattccttgtttaactaatctattagccaatctatcagcaatcattggtttaaatatctcactcaaatctaatgccaaggaaaacctcctctcatgaggttcatgtaaataactaacagttggagtcagttgagtattataaagctcggtgattatagctgggtagagacgagagtttaaaaagcttattaacgcattcatctcattctttggaggtcttcttgtccttttaactattttaaagtcatctggtagggtctcatcccacaatctataatattcagtcctaactctcccctctacgttcataacctctgttatcttgttgcagttgtttagttcttcaatataactgctaaatttagtcttgtttttaaattttaataaattccactccatattttttattcctccaatgataaacagctttgccaactctaatctcttatccttatctaaataatgctcaacttgattaactactaaataaccagagtgtagagattctcttggataaaatgagccgtcataataaccatagtggttaaagaagtgcaaagcaatgcctttctgagctaaataatgtagagcttgggagcttatgctaacctttccatatatgtagatgtcataaattccttcaatagctaagggctttttgcctcttgcattctcaaagtagattgtattttcctttctaaataaatagccatctgataataaagttagggacttttttctcatagtatcaccaaattaaataaaacataactcataataagcacaattttgcagattttctgataccatagggcttcgccctattgggatacccaggatgcattgcttctttgcagaagcaatgcctcttagctcacttttgacgtatcttcgaagtaacataaaattctaaataaaacataattcataataagcacaattcttgcaaatcttctgataaataggctctggtggttcttttaatgattttatgtattcaatctcttttattgctctttttatttcctctttgttattttcttttaactcaatctctttaatctccttaagttttggataatgaaggattgccttagattttattcctaaactgtttaaataatagatgtaatacaatacctgcattatatgggctttctccatctgtttgcccctctttacctcatgaatctcaatgacatcacgctttttaataaaatcaatttttatactacctatctgaacttccttctcctctccaaaataacttttttcatgtaaaaattttcctaaatcaacaaaatcactttcttgctccatagttatgcctctaacaaaataccaaagctttgtcttacatacatagagatagtttatctcaatacctccaattataagctcttcttccaaataattttccataattccacctataagatgtcttcaaactcctcttcctctttgtagtcaaatcctatttcataagtatatttaaatgaacaaattaaatatcttctggtttttctaccaactcttttttcataagggtaaaagtgaattaatccctcctcatttttcatttcatttaaaattaaataggctgggatttttgccatatactctgctcttaaggaattttctcccaattcatcaaaataaacttgaggaactacttcaatcttcataaacttatcatctctaactttaaagaatcttccttcttcatctattgttgatatatctgtccaatgccttccaaataatattgcctcatcaaaaaataactttaaatcacttggaatgcttaaattataatctttataaacattatcaacgaaatctttaatatctctataatccaaaggtttttcatagaattttatatgattaattgttttttctattagttccttgctatatggcaagtgtttatacggcaaaaatatttttagcttgtattcttttccattttctctccaatcttttccttttctgtgcaatcttccagccctctgcccaagtgcatctggtggagatagttcagaatacataacatcgacggacatatcaagagaaatttcaatcacttgagtggcaacaataacataaggtttattttgactttttctcatctcttccaaagtaaaaatctcatcctcttttttaactctatctttataggcaaattgagaatgatagagaatcgctgggactttgtcccttactgctttataaaattcccttgctctttcaacagtatttaagataatcgcttgagataatccttttttataattctctattatttcgttaattatattttcattaactttccattcatcatcctctttccaaattaaatgattttctgaacatttaagtttaaaaggtttgtaatttaacccttcctcatcaactacaagttcataaccttcaaggttgttcattaaaaagtttggcagtgttccactcataagtaaatgaggaatatccatcctccttaaaatatcaaaaagagttaataaatgctctaatgtgtatttttcatagtaatgaacttcatcaaagattataactgaattttgaatatttcccaaagcaaaatccgcctgagaaaatccatgaacaaaagagtatataacatggtcaatggttgttattgttattggtttaaaaaatacatttcccttgaaattttcatccctaatttcctctaaatcgtcttcatcctctatttcttttgagtccctcaattttataaagctctttccatggaataaaccgacgttctcctctccaaagatctttaccaatctatcatacattgcattgcttgttacttgcgtaggcattgctaagatgattttgtttcttttgaagttttttaatgcattcaatgcccaaagtaacgctccttcagttttacctctcccacaaggagcaaacaacatcacaaacttattttttgagttgtaaagttctttttggaatttgtatggttcataatcttttagaataaacgatattggattatcaatatttaaagtaggaacataaatttctggattctctaaaacatcatcaaaaattccttccctgtcttttgcatattcactaaagtttaaacttgcaaaatcatcacacaattgaagaatagaaaacataaatgaaaatattgactttanttttattttatcatcaaagcttagtgatttgatgtaattatttgcctctatccaatatttccttcttaatctgtgtagttctaaaggttttgcatcttttggaatatcctctatctttaagtcctcaaactcaaaaaactttgaaaatccaaragattcataagcttctttagaattttttataaattctttgatttcttctattaaaaaagtcccttttttgtattgttgataatcagcatataagttgttgtaaagttgtgtatgatgagataaaatagcaaaaacttcaattggaatatcgaaaagataatcaaactcaatattttttataatgggaagtgcataaagtggatggggatgtttattgcttctttttcctttttttatgttattttggaacccctctgttatctttccaatatcatgcaaataaatggtaaaaaaagtattctttgttttataaaattatcaagaggtatagtgagcatatcttcaccagtttagatatgactttttaacaaatttaattttaaataatagatattttgaaataacctatatataaacgtatcgatataatctagatttaaataaataaactaacatttatatgtaaagcttatatataaagtatatgaaaataaagtaaagattgaaaagttgttaaaagatagaagtgtataaataggttgttatgagttatgtagtatgattaataaatgattttgtttaacacgtttttatgcaataatgaaaaagtaaataggagatattaacaattattagccacaattaaatttttgttttgagttttttatttttttgatttttatcttcaacatttacaaccattccaaaacccatactattcttctctccaaaaccacactcataaccaaattttattaaatcgtagtccccccagaccttaaacaccatttcagaacacctacaataaatatcattttttattctcatccttttaggtctaaattttaagacttcaaattcaaagttcatgtcacatttttcattatagaatgcttcatatttcttttttagattattctttaagttttcataaaatttagaattgtttggtaataaatcataagtttttaaaccatcttctgtctcaatcatcgtctttaagtaaattggagatatggtttttaatatattgaatttctttggaattggtagaattttagcctttcttacaaagaattcaacatttcctactctcaactttccatcctctaagagtccagcaacaaaattctcaataaactcattgtttggtgaggatatatagagatatgccttcccatctatagtttcaatcccttcctttctaataaccctctttctaatctgcaataaagaaaaagtaaagaacttaaacttctgataattatgtaatcttttagcataggcaggatttgcagagtgaattttattgtatatggctgatgccaaataatactgatgattataaggaattactgtgaagttgtctgtctgtaactctaactcaattctcatactctccctcataaaatatttaaataaacaataacactttattaaccttaggaaattaatgatatctggtggttatatggatttatacgctatggctgaatatcttgtaaataattatggttacattgggatatttataatttcatttacagaggcatttatacaaccaattcccccagatgtttttataattggggcatctttttttggtttaaatccaataatctctgctatagtagcaacaattggcacaactttaggaggtttgtttggctacttcttaggggataaattagggcatccaatatttataaaactttttggagagaaatatctgcataaaggagaagaattttttaacaaatatggagtttatggagttgtaattgcgggtttctcccccttaccatataaagttattgcatggctatctggaatttttgaaatgcataaattattatttacagttggaacaataattggaagattaccaagatttttggcagttgcatattttggagatgttttgggaaatataaatagattaagtgatataaatatttatttattctatttaataaattctcactataattatatatttgatgcaattatgccaatcatctctaaaacagcatatcctttaattgcaatcacatccttaataatatttataaaaaatagaaaattcgggatgaaattaatcttcgccttatttttagcttttatgattgcattttcattaaaatatttagtaaatgagccaaggccttatttagttttagataatgtgcatttgttatgcaatgaaggaaatgagccaagctttccaagtggtcatacaactttagcatttacattagcaacatccttattattttactcaaaaaaacttggaatattgtttttaagttgggctataattgtagcttatagtagagtttatgttggagttcattatcctttggatgtccttgctggaatgattattggaattttctgtggatgtttaacaagaatagatatatacaaattaatagataatatctaaaaaatacataaaaaccagaatattatcaaaagaaaaataaaaaaggaaaaatcaatttattcttctttaaagtattcatcataaactccagcatcaatctctttttggacttctttagggtcttttccttcaactgtcactcccattgaaccacaggttcctaaaacctcttttacagcgttctttaatgtatatgagagcatagcatcttttttcatcttagctattttaataacctgttccaatgttaagtttccaacaacttcatgtcttggttcgtgagcagcggtttcaattcctaactcctttttaattagagcagttgttggaggaattccaacttcaatttcaaactttcttgtttcggtatcaactataactttaactggaacttgcattccttcatagtcttttgttttttcattaatctctttaacaacttgcatgacattgactcctaaaggcccaattgcaggccctaatggtggccctgctgttgctctacctccagtaactaatacttcaacaacctccttagccataaatattcacctcatgtttggagtgtttcaataagaaaattaatgtgtagataaaattaatatatttggtatataaagttatgcctctaatataaatttaatctttatgctttgaaactattttaacaccctcaactggaagggttatcggtatagggacagcggcattttcaagttccaaggtaacttcctctttatgcttatcaactctaataacctttgctctctctcctttaaatggcccagcaatgatttcaacaacatctcctttctcaatattttcaatgattttctttggagttaataaaggttctatctcttcaatagctattgttcctggtactattcccctaacccttggcattccttttattaattcttcaacatctccctttgtctctgcctcaactaaaacatatcctttcaatgactctgaagccaatattgaataaacatccaactgctctttttcagccctacttgccattaatccagctatattcttttcctggccgaccatagttctaactgcaaaaatcataatctcaccttaaataaattttaaaaaataaaatagaggtttagtgaaacgtgatataaaaaaagttttatatttttagggattaaatatagattcaaatatgttgtataaatatcttatctatgttgaacttttaacaactgtaagtgctttttttatactcttggagttgttggaggttttaatattcccttaatgtatgttgctggaacgtgaattatgtatccaataattcccaataaagatattcccaaagctgtaactttagcaacagccaaatattcatcttttgtaggttttttcaaaactaaccaaactctcctacattcttcaataaattctttaagttgttcaattttttgattaaaatctgttttcataatatccccttaaatttttggaattcctgtgagttctaatttttttcttttcaatcctgtatcggtaaattcaattcttgactgaactcctgtaataaccaataaaaccctcacggtattctctaagttctcatctattgtagctccccatataattgtagcatttgggtctaatcttgaggatacagtggctacaacctctcttgcctcttctaatgttaagtcctcaggacccattacatgtattaatgctccagtagctccatctatatcaacatctaataatggggagtttaaagccatactaacagcttctttagcccttttctcactatcactctccccgataccaatcatcgctaagcctccattgttcataacagctttaacgtcagcaaaatcaacattaatcaatccatccttggttattaattcaactaatccctttacagcgttgattaatacctcatcagctaccttaaatgccaattttaacggcatatttggaactatctcaaacaatttttcgtttggaataacaactaacgtatcagtatgttgttttaacctttctaaaccttccatcgcatttttcatcctaactttcccttccattacaaaaggtagtgtaactacagcaacagttaaagcccctatctttttggatatctcagccacgactggagctgaaccagttccagtccctcctcctaaaccacaagtaataaataccatatctgaatcttgtattgctgctttaatctcttcagcactttcttttgctgcctcttctccaatttttggattacctccagctccaagacctcttgttaattttttaccaattaatatttttttatcagcttttgttctaattaattgctgagcatcagtattaatagcaacggttttagctccttctataccctccatctttaaccttgtgatagtgttatttcctgctccaccacaaccaactactgtaatttttgctttagtttgttgcaaatattccaataattccttatcctctggagacaattctaattcattaaactcctctaatttactcccttcctctaaaacgttttttagaaatttcacgttatgacctccgtattattattctgaatttgaatctataaatacaataatagattttaacgctaatactattaaccaaataattatatatgaatattttatatagtattcccttacatggttgcccatagttatcatggtgttgcatattattattattcaattttaaaatgaggtataaaaatctattggttatgggtttgcataataaaataatttaggttgaaattattgaacattaaaaaattataaaaaattacttggtgagggtgaatggttaaacttcctgctatctcaaaaaaaccaagagagattgcaaaacaaaaaattattgaattggctaaaaagatgtatgaggatttaatgaaagggaaaagaccaaagataacaatgccaattagaagcttatctaatgcaatgtttgataaagaaaagggttcatttactttagttggtaaagaaaaggcaagaacattaactgtaaatcaagcaaagatttttgcacaaacaacaaagatgttagagtttgctaaacagttgttagagacagacgatttttcaacattaagggaagcatactatgtttcaaaaaactggggagaggcaagatttgatgaccaacaagcatcaaacaacgttattgaggatttagaggcagctttaggagtgttgagggaacatcttggatttattccagaggaagatggttcttcagtagtaggaccgttaaaaattattgaagaaacaccagaaggagaacttgtcgttgattgtacaaaattggggactggagcatacaacatcccaaacgatgtaacaaaattaaaccttgagacagatgctgactttatattggcaatagaaacatcaggtatgtttgcaagattaaatgcagagagattctgggataagcataactgcatactggtttcattaaaaggggttccagcaagggctacaagaaggtttataaaaagattacatgaagaacacgacttgcctgttttagtatttacagacggagacccttatgggtatttaaacatttacaggaccttaaaggttgggagtggtaaagccatacacttagctgataaattatcaattcctgcagcaaggttgattggagttaccccacaggatatcattgattacgatttaccaactcatccattaaaagagcaggatattaaaaggataaaagatggtttaaagaatgacgattttgtcagaagtttcccagaatggcagaaagctttaaaacagatgctcgatatgggagtcagggcagaacaacagtctttagctaagtacggtttaaagtatgttgttaatacatatttacctgaaaaaattaaagatgagagcacatggttaccataaaaaattattattttaaaaaattaaaaatttataaaaatattttataaaaattcagggttgtagtaatttcttatttcgttaatcttctcccatatctttttaatttcttttttatatacttcatcctctataaggttgtagattccttcaagagaagataggattacatccatcaataaatactcttcttctcctttttcaatatccttcgaaaatataatctttatgtcttctatttttataaagttatttcccacttcaatgttttttggattaaaaactctcttttcttcttttattgattccttaggaggataattttttaaactttcgaactcatcaaaagtcatgtcaccacccaaaatattaatctatatatttaaattattcaattttaataattaaaaacaaaataaaaatagaaatagaattttaaatcattggcgcaggggctgggatttgaacccaggcggggcaaagccccactggatctcaaggaatatataaccacacttaactcttctaaactcccctgtgtcccaacacctcaaaatttaccacttacatcctaaaaatgttccaacaacaccgcattactatactgcaccaaatccagttaaacaaactactccacaacaaccataacttactggattctcaacaactttttaataaactccaaactctcagccctctccttagaatgagcataaatcaaagtagtgttcatcgacttatgtcctaagtattcctttacgatgtcgatgggcactcccttattcaataaatctaccgcccttccgtgtcttatactatgaataacaatacgcctatttttagggattttaccctcctctttcaattcattcactgcctttctaaacacttcactaatccactcttttctaaccctcccaccctgagaattctggaacaaatagtcatctgaaccttgccttacattaaactgaacataattcctaagcaactctaaagtatccgatgaacaaacaacagtcctctcctcatgagttttggtatttcgaatcttaaatatgccattgtctaaatcacaatccttgtatttcaaattaagaacctcagaaaccctacaaccagtgtcccaaagtaacctgattattaacgcatcccttatcctggtcctactcccactttcaattatcttctttaaaatcatattcaacatttcagcatcaacagcatcataatgttggatttcaattctcgcgaacctcttcctatccttactctcttcaacgaactcctgaataacattatacattcttaaaactctataaaacacttttaataataaaaaatacttcctctgcgaacttttagatacttttctaaccgtatctaaataattaaaaaatttaacgaaatcacttgtttttaactcttctggattttttccaaggtaattaatgcaataatctaaaaacactctcaacctgtctaaatcactctttatagtgctctcttttatcccatcaaatctcctttcatcttcaaacctttttaaatattctttaattttatctgtctcttcaattttctctttcttaaccttcaaaagtaaaagattttcaatatgtttaagctctttctccctcatccaacttcaccaactcgcagttcaacaacaaattagcacttttacctaacctctgtattataacctcctcttcctctgtgagagttatagacctcttatatttcttttcagcttcaattgctcttcttagagtatctatatccacattttcaacattttccaacttatgcaaaagatacctaagtttcctaccgtcaatgtttttataaagataaaatgttgccctctttttctctttcataaagcccaccaaaggcattattcctcaatcaaaccacaatcaactaatattttatacaactcccaagttctctctaaatccctctttaaatgctcacagattttgcgtttagcttcttcatccccttcctcttcaaacttctcccaaagctctggaatttcactaccattagcgtcatcttctggaacgtcaattcccaaaaacctacagtaatccactaactttgttcccttcctatactgcccaccactcccattcaatatctgccttaaatctactctaccttggtattttctgaaatgctttattttcaacctatgatataagcttctcaattttaggaactgccaatcaaagtcaatattaaagccgattattttctcaataccttctttttccaccgtatcccaaaaattaaccaacaaataatactctgactcatccatcagaataatatccctatccccaagttttacaccaatggcaactatacggtgctccatagggttgagtccagtagtttctatgtcaatgattgccttagccatgctatcacactctttctaagtaaataatggctttttcagtcgtcaatttattagacttgtaagggataaaactattaagcaaatctacaaaatcttgatgtgtttttatgttaaaaccttcgaattctgcatctttctttaatatttctaaaggaatatcacaaattcttttaacctcaactccaacgattttagcaggaaactctccacttggatgtttaatttttacaacatctccaactctcaaacccttatttttcagataatgcttgcttctaattgttgtaaatctctgttctcttaatttgaaataatcgtgagagaaattaatttcaatcatactccccacctctgattatcaagacataagttgccaataacccgactttggagaataaatgtctccaacccgtttcagataattaatagcatcctcaacttccttctcagataaacccgccctttcagccctttcatatatctcttcttcaggagctaagccgtcatctcttgagttagaaatttccttaataatattcagaaccttctcaaccttatccctcttagatttcggagttccagctattttgtcaatgtctattgaaccactctcagggtcgtaggcgatttgttttaagcaggtatcaactaaccttatagcctcttctgcatcaaccgctttaacaacttccgacaatcttaactttgcatgagcaactgctaatctgattatagaccctaactgtcttgcagatattccaaaagttccttttgcttcgctcatttttcttacagaaacataatactcttttataatcttacgagcttcatctgatatttctggctctatttgtcttgcataaagaacatacttcagcaacaactcatcattcaactcaacaccatttattacaaactttttacccgaagattttccttttctctctctaacttttgaattataattatcaatagagaaatctgctatatcctcatctttctttttatcaatcttatctttaatcacaaaaatcaaatcaaacctatccaataactccttaggcaagtttatctgctcccatacggttaaatcaggattaaaccttccaaaccttggattacatgctgctaaaatagcaacccttgctggcaatactgcatcaataactccagccttgttaatctcaatcttctgctgttccataactcccaagagataatcatatacctctttattccttgaaaattcgtcaatacaaacaactcccccatcagcctcagttaaaaccccagcttttaatacccaactatctccaaactctgccttctccctgactacagacccgaccaatccaggacctgatgaagtaacagcataaactttcttaacaaatggaaacttctgaattaatgactccatcaatgttgattttccaaccccagggtcggaaatcatcaaaatatggatggacgttctcatgtcaatattagtcccactactaaccaactgtaataaaacagctctttttatcatatcatatccagtaacttccctaaaagcatagtcagaaagcttttgaataacgttcttatccttagcaattctattaataagctctaaatctttttcattgaggtttttagctatttcttcaatatcttcatcatccttttcaatgtaaaaagcatgaatgtataattctccaacactcccgtttttattttctttaacaattggaactccaacaatcttcacatacccagaatataccgctttctttggtttgttaaattcatagaagacagttgtagaatgtttatttgcatatattgactcctgtaatggtgtttgaactttaatctcctgaaaatcaactttgccagataaatcttcatcaaatattagtcctttacaatcacagccatcagcaggacatgttaatgactttccaacttctttaggtttatcccaaaatcctaaatccaatgtctttgtagctccgcactttggacagtaatagaatcccttagcataccttagtttaagtttcgttgcttggagaatcattgctctaaactctactaattttcctttatgggcagatgataattcagataaggaaattctacaatcaataggatttctaatgtggataaattctacgttaggtgtttcgttgaataattcttcataagcttcaatatatacatttgttatcgatttcctaacttcataagggtgttctattaacttatcattcaaatctccagattcagggaagtgcattataaattctttcacgtcaaaaatatcccactctggtccttcagttgataacttgtgtttaaaatactcctttaatttatcagtatagtatgccaagaacatttcctcgtcaaatacgttgggagcttgaagctcataagggtccttaatgagagttataattttctttccatcaacaatttcttgagatataacaccttcagagattaattgggatttagcgtttgaaactgattttgggttaaacattgcctttaaagtaggtaataaatcattatcccaatctgcttgtttgttaggcattctttttaacatgcctataatttctctttttatgttatcataaaccatgtttatcccctaatttatgatttctcagtttctacaatctcaaattcttcatttccgagttcatcaagtattgtaactaaaactttgcatccaacgtaatctttaggtattaagatcattccagagtttcctattggtttaacaactcctttgaatgatattgttgcatcttttggcaatctccatgttttctttctgattttcatattatcactatgtagtaatttatcactatttggtgagtaatataattaaactgatatatatattttttggtgattcatcacgctttggtgaataatcacataaataaaagtagttgtaaaaaattacaataaaaacaaaaagaggcaggtcatattatgatactcaaaatactggcaaaaaaacacgtaaaggatgttttaaaattactaaatagtaaagatatgtattttagtgaattacagaagactttaaatttacatccaaaaattttggactcaatattatctgatttagttaatgaaggtttcgttgaaaaaagagaaggagaatctccttataaatttggaaaagtatattattcaataaccccaagaggtaaaagagctttagaaatattagatcttattgaaactttcgatactcttagagaaggccaagacatcgttattaattataaaattgtaaattcaactgcataaattacttctataggatactatggctctaatatcgtatttagagatggacacatatttgccttatttggctcaaaactcataggattacggtttatttttggtttagaggcatatttataaaagagcttaaaatgtcctcatctctggacttaaaaggataatttattaagtttatgcggtttagagacatttaaaccgatatatttagataacggtttatattccctaaaccaagaaaataagaaaaattaagtttgaataccttagggataatcccaaattattcgatttcataaataaacgtctaaaccgaaaataggacataaattatttaggatttcgtaaaatctcaaagaattatccttatctctaaatccgacacatctcgggacactaccttaaaaatatcaacaatcgttaatatactaacctcttcacacattgataaagcttatatttcatagttgatatattatagaattagaaaaaaggagttggtgagtatggataatcaaactatagttacacttatgggtttggcttctttgggattgattgttttgttatctttagctttatatttgtggtattttaaattgggtggtaaaaaagctttagaaactaattaaagttttttgtagatgtcatataaaacagcacataatagccagattgttattagtattgcaagggcatctcctataaatagcacaatacctgtttgtaatgttatcattccagatgcagtatttaggatgacatacaacataaataaaaattcgtatccaacaaaaactattccagcattagctattttgtcaaataaaagcttccgtttttcatccataattaccacaacttagggcttttatttttctatttttctaagtaggtatttaaataatataaacattaacaatcatcgatattctaaactcgtatagtaatcattatataatattatagaaacatttgaataattgtaaaattcgaagagggggagtatgaaaaggctgggtgtgtttttgatacttgccagtatagtatgtggtgtggttgctatatgtggttgcactggtggaggaggaactgactattcttcaagcaccgcatctgcagaaactgagacttgcccagttcagatattagagcatcatttagttaggaaagattatgggactgtgtatgttgaaggggttgctcagaatgtaggtaataaaaggttaaaatttgtagaaataaaggcaagattttatgatgctgatggtgttttaattgatgagttcatggacgtccatagggacgttgaccctggacaaaagtttagatttaaaattattggacctataggggaggaaggtaaaaaagttgctaagtatgatattgctgttggaacttggtggactgaataagtggctgttttaaaatgctacgatttgactgtaaaataacttttcaacttctctttttctggtcctattgtgagcatatcaacaatcattaatatattatctgctggtcctatggatactcagcagtatctgttattactacctatgtaggttccctgttgatattaatcgaaaagtaaatataggtgtcggcaggaaagtatcagatagagtatataatagtatatatacaggtatatactcctgtatatatactataaaatatactggaaagttcggaactgatacactattagggtaattagtaatattggtggatgatgtcgtatgttagaatgacactgtatcatgggaccgacagaaagagtgcagaaaaaataatggaaagtaaggagatactacccagccaaggagataaccactggcttggggatggtatttatttttatgaagaggagttccatgcgtttaagtggatatggtataaggagaagaaccgcaatagattactaaaaaattttgcaataataaaagcagaagttatatgtgaggaatcgaggatttttgatttaacgaagattgaacataaactcctatttgacatgatgtataagttaattaacactacgaaattgaggttagataaactcagaggagacatgtgtgcggaaggggttgttataaattatatgttcaagaacaaggagctgggttataataaaagattcgatattgttagagctttgtttccaatacccgtaaaaaaatatcaaaaaatagaaaatcgtgagaaaaataaaaaatataaagaaagaacacatagattaacatttatgcctgagattcaagtgtgtgtaaaaaatccaagtgttataaaaaagttggagtggtatgatttggagaagacaatagataaattcttaatttatactgaaatttataaagaagatttaggaatataggtgagattatgacatttgatttattaaaagaattaaaaagaatttacaaacattttgaaaatattgatttagaacaatttgagagggatttaattgagtgtgggtttgggaagataaagccaggtccattagctacagatgaggtcttaactgaagaggatattgctaaatatcgagagataataatgaagtcccaaacttgtaatgttaacacccacaaccagattgttattaagattaatttaaaggaaataaatgctgataataaaatgtattgtaaatttaggaagggatataaatttaaagaggatataaaagttggtgaagaatcaagttatattattacccttcagcaggatagtttacatatttgtaataattatgaggtggcataaaaatggaagctccaccaaagtgtgctttaaagttttccaattatattgttaagcatattgaatttatactaaatgaagtccctgaaaaagatgaaaagataaggttgaatgtaaatattgatacagagataagatacaataaaaatgagccaaataaatttataacgataattaaaataacagctggggagaaaaaggattttgctaaaagtccagtttatttgtctgttgaagtatggggtttctttgaagttattgaggaagcgattgataaggttagacaatttgcagagattaattctgttgcaatattattcccttatgttagggctttgatttcaactattacggcgaacgctaatattcctccggttatactcccacctataaatgttgctgggatgatggcaaacattgaagaagtaaaagaagaaaacacggaaaaacaggaaacagaagcttatgagtaaatctatttttaaaatttagctatttttgtatgacattgtattttagtgtattctattgtgtattactttgtattcttttgtattcttttttgtatgccattgtaattcaatgtattctctttttgtaatacactgtctgctggtgtagtctttctttttttatcctctgctattaatttttctaatatctaccattaacaaacttagagagtaaggtttagccaaaatatataaaaccaataaccaagataaaatatagcaacggtaaaaggggttggtgtttatgaatattggtgtggatacatttttatttgttgcgttattttccatattcttacttgtattatttgggatagggctttggatttggtattttaaattaggaggtagggagaagayatttggctctgattaatcttcaatttttaggtaggcatcataaagcacagttccaaaagttaggagtgttagtataataaatacaatatctccaactaataaaatagagcctgtttttatagggatagctcctgaagatgtctgcaaaattgttgctccagcaaatacaacctcatacccaaatattattttaaaaatatcaaaaatcgcatcaaaaaatatcttctgtttttctttcatttaaacaccatatattaccgttttatgagaagtatgtatttttacggtttttattatttgctgttattaacttttttaatatccaccattaacttttttagagagaaaggtttttatattagtttaattatacttactcaccaagaagtgatatatcaccaataagtgggtaaatgaccacccaaggataaccagctttaacggctgggaccccttgggtgtgatgtaagccctgaaacacggcccccaccattaacccctcccccaccaaatataatttttttagacggggcgagatgaagcccactatttattggctttaaaagagtttggagggttgattatgaagttcttagtcgtcaaaaaaggtagtgaaactaagagaatcaatgttgaggagattaaagaaatctcaaatgttgggagttttgttatcatcagatacagtggtggagaggttaaaataaaggctaaaggagatgctgaagaagctgcggattggattactaagatgattactgattttcctaataagattattgatttgagagctggctttgaaagcggagataaagccaaaaccaacttgagggtggaagcgtgttgaggtttaagaagacaccagatgaagttaaagagatgataaaacttgcgattaagaagggttacaggcagattaaaattagtagtgtcaatcctaatgagttcttattaaggttcgatggcagaatgtggattatggggtttgagtttttaagcgataaggaaattaaatactcatgttttgagaattattcttttaagtgcattttagaaacggatgctaagaaagttagagagtttttggaagagatttattcaaaatctaagatagttaatggtagagttaaagagattcctacagatgtttttcaagtagttgttgcatagaggcattttttctttttcgagttttctatttaaatatttttggtatttaggagcaaataattgtaggtgagaatatgcaaataaataaagctatagaattattggaaagagcatggagtgattataataatggagacactgttggagcgattttgaagttggaggaagctgaggatttgattaggaaactgagggttaggttatgttctgagattaggagggagggctatgatgcgatattcatcaaataaaatctattttatcgtttatttaggtggaaagcctgtttcttttggtgtggctaaggatgttgatgagtttgagaggaggagggagaatattgagtgtttgagtgataagattagggttgtgaaggttgggaaaaagttgtttaaaaggttgaggaggcagattttggagggagagaaaaaggattttggcatgttgaaagttaatcggagggatttgaatgtgcaagtatgagttagctgcaaaggctcataagaatgtgtatggtgtagagattgaagttgaggagattaaaaagcaagttgaagaaatcagaaaggagcataataattggattgatgaaagtgcggcatttgtcaaatggttagaaaccttggagcttaaggatgaatttaaaaagcttagggaggaggagaggatgaataagaatgggaatagtattgaggttaaggcatcaaacaatgcaatggtggtcttagagaaaactgctgaaaaggttgattcgttggatgatgttattgaaaagatggattcgttggatgaggatttaatgttactggatgaagctaatgagcatctacctttggcatatacttatcctgataaaaaaacaggaaaggagaagataattctctcatgggcaggaattgttaaagcaatgaggatgcagggaaatattgaggtagagcccccaactttccaagaggttaatggaaaaattatagcaacgtgtagggtcagggatttgaagagaaacatcgttatggtaggtactgctgaaagggtaagtcctggtagaatgggagaggagtttaaatatactgtcttagcttcaaaggcgataaggaacgcactaaagcacattattgagccaaagtatttgcagatggtaatagctgaagctaaaaagagaaagtcgtatgtgattatcacttattaatttttttaaaatttttttggtgatgatatggtggaaaaaatgagtcccaaaacttttggaggtgaaatcatggagaattctgatataagggctaagttgttggaagttttagagtctggtgttgtaaatgggaaatggacaattggaatagtgaggttgaactctgaattaagaaggttgctggttaataggtgccaatgttatattaatgattcagagactacgaaatctaagacaaagattattgctgagttttgcatggatgcggctgaaaatggagttaggtattctcctgatttggtaaatgcggctttgacaatattaaaatcaatgggatataatattaaagatgtgcagtgttattatgatgtagattttcctgctgtgattactgtggatggggaggttggtgttgtcatcaagccagaacacatggaagatttaagggttgttggtgttaaaaaattgacagagttttaaactctttttttggtgattctatggcaaaagttaggcatggttgtagaactgagagaatagagttgattattaaaataaatcatttgaaaagagaaaatctaaagcttagaaataaaatagctgattataagagaactttatatttaattagaggtaagggctgtaaattaacagaagagttattaaagattgagattgagaattgtattaagatgataaagtttaatgaagagacgattagggacttaaaagagaaggttgaaatgataccaaatgaacaactttaatatactttgagcttaaaaatagagattaatgattacgtggtggtgttatggcagttgcctatgctaagttatatgagttgatacttaaaaaggttaaggatgaaaaagaggcagaggagttgtataatgcaattatagagattgttaaagaggaaaaacttgcagttaaaactgaattaaaggatgagttgaggggtgaattggctacaaaggaagacattaaatatttagacgggaaaattgaaatggttaagaaagaattagaatataagcttattatacacactttgataatcttatttgctataattataactaatcctaatgccatagagttgataaaattattatttggatttaagtgattttttattgatttttattttttattccaatttacatttattaatttaaatttacttaattaatgataagtaatctttcaacaattttaactggtcgtttcttatttgaatttgaatgttcgagtttyctaaactgaatcttacagaatatacaggcattgaaattagttgtccattataatctacagtaattgaactgtttattttttgaagttctttacttaggattgtraaggtttctattttccttggttgtcccatttctctaactattgccttagcgagttcttttaactcatcatcagtataagttggtaaatttaacgtcattgggctgccataaatcctataacaataactatattgttttaagtccctgtcttcattcagttgttctactacactaaattcgcatattggatttacaaatgttccagatacagtttcataaacctgatttagtaaagtggttccattttcatagccagttattccttcaaagttccacaaaccaattctttctattttgtcgctatttattattacattttcggcttcaatgttgtatttgttgtaatagccgttttcatcgcaccaatctttgtctatatagattgcaattccataatcttgaatattcagtgcattatcggcagtgtttggtattcttacttcataaattccagtgtttattttattcagaggatattgccaattaataaatatgttttcaattggaacatcaatataattgccttgctcatcttttatttttattttaacaattatttcagagtgtttattttcatcataatctgcactcgttggatgtgggaatttatcagtttcatttccttctttgtcataagtttttgcttcaattgataaactatgacagtatttttgtctttcaactattatttgttctttcgcaacctcaactcctccaataaaaagtttcatttcataagtttcaatggtattttgtggcattctaaatgtgtaagtgaaattgcttacatctccagtttttgaatctactaaaacaccgccataatataatctaagttcaggttggaaccaacccaagtatttagtatccacatttatctcatattctatgtcgaatgtgattgttttttcatttgggtcggaattcctataacatatacacttgggtcttacgatgaacttttcacagtatggtttgacgttgtaagtgtcaaagtagtaaatgtatggttgccagccccatttgttaatatctcccaatggaacttcacaaggtctaaaatacacaataagaggaacgcaagttaataagttgcccgtatatttctttttgaatgcgataatgtcaaaatcacatctttctgacaccccagattcttcattacgttcaaaggttccaatgcttggttcagcttcaagatatgactctttatgaacagtccagagatatattgcctttgggaagtagccatcttttatcatttcctcataataaatactaacatatccatcatcactgattgtggcatattttgaatctacagagttacccttatcgtcataaaactgccaactttctaaatcaggaagaagagttacagacccccaaaggtattctattgtggttgggttactcgcatcaccagtgttaagtattcttttctccaaatatgttcggttttgaattggattgatgtaacctcttgggaagtgttttggtaggaagttaccaaagacaatgttgatgttccgccctatcaattgccaataatcctccgtatctgggtcaaagaagtcgtttatattgttattctcaataatccacattagagttacagtgagagaacttccagagataccaaatgatatattcaattttccatacttaattggaaactcaaggattttagtcccactttcaggtatatgaaaactcggcccccatgttccattcatccaaattttgtaatcttgattattaaacatatcatcagcagatgtttgtatggtaagagtgtatttgtatggaattggaaaattgttgtcaaaatatgcattatatgtagcagtgacgcctgcatcaggtggtagattgtaaatatgacattcatacatacattcctggaacatcgatgggatattgaaaacaaaggatgaacttggagctgttggaactgatactgtagatacccagtgaagtggaacactcctaatttcaactccatccatctcaattagacccatttcgcatattttggatgataaactgtttatattggctggccaggggtaattactgttaatgtattgtgtctcaccagaatcataaggattcacataatcactgttcaaaccaagtgtccattcttttaatttatcatcgaaattttcttcatcaatgtaatgaacaaagggcattattaccaccttacttggtttataatctcagtatcccattcaaattcataaccgacaactttctcttcttttggatgttgtcctgaaattttatctgtaaaaattaatgaattgtattcataatcaacgtaaaatcttgtattgtagttttttgtataaagtatgcacttttttaatgcatcaaaataactactttcttcaatgtaaatcagtggatttgaatctaattgataatccagttccaaattacataaattgcaacactcttttaagaaaatctgtaaaaatgtagtttttgccgtagttttttgctggcttagaatccagagggggctgttaatagtatattcatactgttgctgtccaaaactctgtgataatcttgcatcaatgcaatatcctctgaaaattattttatcattccaaagtataatacattggtcaaaaggttggatttgtaaatctttcaatgaagttatattacactggtcaatggcattaattgaatactctatatctacggacattgatttatctatgacaattgttttcatactttacaccatatactttaatatcctattgcaaaccagaaaaatcctacatctccacttgcaccactgatatctgtaatacaaacaacacaccctttagttgtaatgtttgcaattcttgttatacatttgatatagtcattatcaactccagaaccctcatatattgatgcaaatacgtttagacatttgttcgggaattcaatggtaaaatttacaggaatttcttgatatgatgtggtattattgacataaaccttcccccactgcataataagccccgttggaaattttatgtatccattatcttcttttaaatctttaaatgaatcaattgataaaaaatctgatgcatcttttccgtctaacttatcagcatttcctgcctgatttgcgtagtcgatgtatccatctgcatttgaatctattgaaattttctttatttttgcaaaagttactgggtcaaatcccatagtatcacctttattttatatatgacacccaccctgaaacagcagaatcaaatgatattttcatatatgggtgcttaatgggtattaattctgttttttgtgcttggtaatcgtatttaacaacttcagaagttacagtgtcataattttctccatcaggagcataatacactttagcatatacatccgtatcgtaaggattcttaacagttaaaactaaacctttggcttcatcatgaactctaacataaatttctggaagattttcaaatttgactgtctttctttcgtctgtaagagtaatcatgtcttccattttatcaccttattctaaaattataagttcaatatcagcataataatgtccagtagttatccttgacaaggaaatactctgaattaaagcctgtttccaatcaccaatctcatcaaaataaacttctatcaggggattacttgctaactgttgtaagaattgcatttttggaattgaatcaacataaagagtgaaactccaagttttttgttcctgtcctaacacttcataaactggcgttccatctacggctggttgatatgctaagtttggttgtggttgatattgcctactttcaactaaaaagctgtattctgtttcattctgtctaatttggaaacagctacttttattagccattatttggttatataaactaacaactaagttttcatcaagagtaatgttatattcttgtgattttccattagttagtgtagttgttactttgataattccattttcaattatgtaacctgttttactaaaatcaactgaattcacacctgcagaatatccttcattgtaagcactattgtagaaatcggttaaatccaactctttcacatcttctgttccatctgaataaactatttttgagatgacttttttctcttcggtgattaattcaactgtatgtgaaacaacagtaggagttgtagtatcagaatctgaatttggattagttggtgtattcattagaattggagtattgttggacagtattggagtttcattagaaatgtcggtgtttgttgagtctgaagttaaattgttcgttgtgttagttatcagtgagttttgattggataaaagtggataatcgtaactaacactgccaccattgccatcgtttgtagtattcatcaaaaaaaaagtattgtttgagattagaggaggcataacaatcaccactatgctaccctttctgcatctggtagttgcattggtaacacagtccataagttacttttatcaactgttattgtttcactggttccatcatcataatttattgttagtgtgtcagttccctcagtgtcattgtaaatgactttaaatattccaaatcctggagcaatctcagtgacagttccagattgactttgaatggatgttattattttcattgagtctccaatcaaaaatgcaattattttataagtttttgtagagtccaatgttgctgctacttttacagttaaactgccaggtgctgaagtaaattcttgcattggtattccattacctgcatcatctaataccatacacataaacggataataattaaatggaatccctattcctatcgtttgagagtctataattctcgcatctaccccagtagtgaattctttataaactatagctcctttgccaataattaataattcattagtttgttgtagtaatgactctgtaggttctggttctgtggatgatgcaagtacggccataatatcacctcatctaaacctttgttttttcaaaatcaaagcaattttttgagctaattgatgctcattaaagctatttccaactacatttatgtgtatatctccataagagtaagatgtgctgtgtgttattcctacttgttgaattttccaatttttaggattcgcggagctcatcagtttagcagtataatcaatagttttctttaagttaggaatttcttttctaattccaccaataatgttttccataaaatggattccccatttatcgtcgtcttttaatggccctacatctggagtggtgtgatgtaagtaactggagataatacccgcagcttgacttacagcattctccaactctgaaaatttctcttttattccatcaattatattttgaatcaaatcactaccccagttcttagcttcttctattttttgagaccaccattcattcaatccattccaccattcatcaaatgtttgtttaatgttatcaacaaaaccattaaatgcatctaatatttgctgaggtaattgttgccattgctgagctaagttttcagctgcttgtctggcttcatcttctttcatccctaactcttcaaatgcctcttgtaatgtattttgaacaacgctccaatcaccagtaataaaactatatattgattcaaatgctgccaagagtgttagaattccagctcttgcagcggataatggtgagtccccatctaaatcaaacaatcctaagaaatcaccaactgctaatgtaacagctgctaatgcttcacccaatgcaacaggccaagccgctaattcaataagcccaacttttaaatgctctatagctccttgtatatctccttccaatagttgttttactggctctacaacaactgacaaaaatccgaaagctcttccggcaaacctaacagcttcacctaagcccttaaatgcattagataatccagagacgtttggtaggttaatttttggtatgttgatttttgggatttttggaagttttaaatcaactggaagtttaattttaggcatgctaatttttggaatttttgggatttctaaatcaacaggtaatttgatttttgagagttctggaagttttaaattatccaaactaattttaccaaataatgtggatttaatttcaccaaaagcatcttttaatgcagaaccaattgctgcaccaattgctatttcaagtatttttccaagacctccaagacctactccaagctctgccccatattgcaaatatccatgacctgctaaccagccctcaatatcctgcttaattgtttctaaaatacccttttggtctttatttatgcttattaacctatccaattcgttggtattgtctggcaagcccttatctaaatccactctctgtaaataatcatgaattttaactatttgttcataagttaagccatacttttttgctaactcagctaatgttttatcatcttttgttttttgaatttccctcaatgctttttcaacatcaaatcccatctgtcttgagtttaatgccaaatcatttattgcctctgccaactgtccaacatcttgagctccagctgcctgtgcttgaattaatatagatgcaaatttctcagggtctaaggtatctcccatagttatgctgaattccctaattgcttctgcaacttctgtatgcccttgcttcatttctaaaacttcagcattcaccattttcattatttcttcatttgattttcccattgctgttagtgctgaaatcatccttgctatatcatcagctccaggttctcctcctctttcagccattgccattgctgctaatatttgagctgcatatttatcgtttgatgctgccaactttaaaaccgcctcattggaatatacaatcccgtctctaatttcatctaaagaatagccgttatataagccgatttgtattaatctctctgcttggtctttagttaagcccctttctcttaaaattgtcattagttcgttgtatttttcagcgtcggaaatccccatgtatgcagtccctacacttgccacatctgcaattgcgtttatgtgatatttttcagaccattccttctttagtttatcccattctgtcctatccacttcaacctttgccctaattgtttgtttttcggataattcactttttattttattgatttgttttaatatctggtctgtatttgttttaatatctatttttgtgtttttcaattgttccaattcactttttagttttgataagtcataatcaaagtttatgttcatttttgaggcatctgcctctatctcttccaactctctaattatcatatttatattgctcttaaattcaacttctgatttgacattttttaactcatccaactgcttaattactgcgttgatattgctctctatctctaattttgattttattttttctaatgattttagatttttccttacatccttatcatccaagttcaattctaacgttccttcaacttttaattttttcatacaatccacgcattaattgctttcctaagaatacaatgatgactgggacaattaaacctaacaacaatgaatctgtatatgtccaaatcactgctgaaaggcacgtgcttgcaaacaatccatagcagtcagggaactgaccatcccagtccaaagctatataatccccctctttaacaaatcttaaaccatatattagggataaaaccaaatcccatgcgaatactacaaaaaatgctaagactaagctaatcaatgcattatgaataacctccataattaaaccaaaaaatattagtccatagtatgttccacttatgaacaacataccgaatggtgtgagccatctcatagaatccccccatattttaacttatctttcatttctctaattgcaaatcctaatattatattgtaatccatcttatttagctttatcgcttcactcggggggattcttaaaaatttacaaacaaaataaagctctgttgcatcatcacttagtgcccactctattgcgaaaggatttatccttgtttaactgcttataagcttcaaagtactttttgatgagttctgcaataacaatcgaaggtaattcctcaactttctcttttggaataccatataaaattggaatgtattttaatgcaaaatctaaaggctccaggttctttgcatcttcaatcatttctttttcaactgataatggtggaattatagctgtgagtttctctccaaatatctcaatttctaattgagggagattagaccttattttttctaatgcttcaagattcttttgttctgattccttaaacttctcatctaatttttttaaaaattcatttttatccatttaatcaccttatttaacgtcgataatctcataactttgggccgtcaaatcaaatgacttactcccaccactccagtcaaactccagattgttaggcatcgctccccttattataacaatcctctttggaggttcaactccataagccatcgtagcttctttagaaaatgcaagaacaacaatgtttgcactttttgaagctccatttttgtattttgagtatgtgttgccttcaagaatctcccctgagaaataagcagtaagcttaatgtctccaacggtgatgatatctttgaatgataatgttatgcttgaacccttttcgatttgaatcttcccataactgcaatccacagtcagctcttctttatccttatcctcttttacggataattctgaagctcctccgagaggtaagtccaaatagagatattcaactgtaattgatgcaccatttgctggtggctgtgtgaatttaattttcttcaaaattccattttcatggattgctgtataatcttgcccttcgaactgcaaaacaccatttactttaacaatctccgaaccgagaaccgcatcatcttttgttaattcaaacgtatcattttgctcatctcctgtaaaagtatcaacctgtgattttgcaccaaaatatgccaactttccacttgccaaaatattttcttggcttggtggagtaagtgatagcaccattatctcacgctcctaaactctaacttagtataatcgctttcaaagtcaattctttccaaataagagttatatgtcgtcataactgcttcaattttctctactaaatcctcatttggtaatttatcaaaagtaaatgttgcatctacataagcaactctattttcaatctctactgagaaatccgcctcacaatggaagtcctgaattttggataaaggagatttaactttgatgccattgttttttaaatcttcaagtattttttcaactaacgcctttgcattagcatagttagtcaaagaacaccgccccctcttcttcatttaattccttctgttttgcttcctcaatagcaatttgatacattctataaaagtgattagccataactgaaacgttttcgtcagttttcatatcccttgattcagtgtagtaatagcaagccaatatggcaataatatcaacgtcttcaacctgggatgtttttattgctaagtttgcagatgcctctgcttgttcaggattggcaaattcttcatcagcactcattcctaagaggggcttcatcttcgctaaaatttccgaaacatcaaccataaaaatcacgcattatcccaatactttttgaatcttaataattccattcttttccttaaccatagggcttattgcctctgtaaatataaactcaacctgagtcgctttcttttcaataaattggtctgcctccacagctactcccatttgaagaattgcaatatcaattgggactaaatatgcagatttatcagtgattaagtttgttgggatgatttccttaatgaaatcctttgtttcatcataagcactaaaaccttgagttcctattttcctaaaacatgcaattgcatcaactggagctactaacgcacattttgcatttgaatactgctcaatctttgtttttgcatctatgatgtcatttgctattttatctggagtggtatctgcaccattccatgatgctgatgcacccactgctgtattgtttttactcaatgcatcaattgagtattgattttcagcccttgccacaacctttgcgagaccttcaaaaatttgtgctttattatagtcagcattaggtccttcaacaaacctcctcgcttttgtaactttcagattaatgtcaaatactgtgaatggtgaggttgttgtcttaattggaacttctgtcaattccattgaaccctttttaaacgcattttcatcaaacacaacttgaactaaattataaacctccacatcttcaggaattttctttttttggaaaattttccttgaaaataagtttgaatcaagtattggtttcattgcctgctctacaatttgagcatcatactcattaagtgccatcatctcacctctatctcaaaataatagtgcagtaattcccctcaacagatgccactttgaaccctgccttaatcgggcttttaactgccttgccactgccatcagtgcttggaataacataatcccctggggctattgattctccttccttaatttcaactttctgaacaccattaacttttaaatcaacatacattccagctgtgtaaatcgccctgctgttaataatgactccatccgcatctattgatatgctatcatcactcactgttgaagttccaaatccaattccagttgaagttatttttccaaatctgtatggtgcgaggtctgcaattgctatgccagagatgatgttttcagtagtcatattctcaccttataatcccagattcgctcttctatgacccgaatttccagaaccagaaggaggcactggtgcggatgcgagaatttccttttgggctttcctaatttcttcaagctgttttaatactgacttattcactgcaaccaattcatccattttagaagcgagtatttcaacaaccttatcatcttcattgtcgcttttatccttgtcttcattttcttttttatgggaagccaatatttgctcaattttctcatgtaagaacttctcaaattcttcttctgtcatgtctttaatttttttaggttcagttttttcctgtgtcttagtgtccatactatccctcttaattgatgccaaaacttcgagaacataattcccttcaaccaacctcgcaaaatctactttcgggtccgactctaagcagagagctaagcccttcataataccttcttcgccaacaccatcatcgttaaattcaaaagaaactcccttgatttttattccattatctaccaaacgccaataaatctcatcgaagattcttatatgggcatagaggttgccctcgggattaaaataaacatcaaccacgtccccaactgcgagatttccattagaataataattatggtcaatattgacgggcttacccctcaacgtaggaccgtattttttaatccactcttcagttatttcttgcccatcaatcgttgttggatttaaaactggaaggaatattgactgcatatctctccctcaaaaagaaaaaattagagtttttttaagattattttttccagaacttcaaccttaccttgtaacttggctacctccgattccaagacctcctgctttcccttttaagcccctaatctcctctttaagttcttcgatttctttttctttcttagctaattctgcttttaattctgcaattttctcattttgagaaacttcgtgatagaactgctccatctcatgttttctaactaatgcatcaactttgtcttttcttatagcttcttgagcaatcttctcaacataatcactttttttaggaactaagtcatcaattacaccattgtctttctcttttttgaataaccccattttgctcacctaacaattttgaacaaaatagcagagtggggtagccccaaaaagatttttatcatttctattatttaaatattgtttcatttaagtgaaataaagtataaatataagtttgaacaaagagaaatacggggataacatgatgacagactccgattcaaaacaggcaatttttatcattggcgttcaagggaaagaaataaagaacgttgaacaattgatgcaagagcttagcaaaattgttaatgaaggttcaatatacaggtattctaaagaaacaggtcttggaaaaggcacacttcacaaaatcaaaaataatgagttgcaggacccaagaatctcaacagttttaaaattgctaaaggcttcgggaaaacgattggtaataattgatgaatggtgaaaatatggacaaacaaacagttatcggatttgtagtattgttttgtgttttggaattagttttctatctaaaaaaactataccaatcaatggcattgactttagctgtttttggaattttctcattattgttttttctcctctatatacctgtccttagcaaaaaagctgtgccgtatgttattaactatttcaaacctcctcatcaaagagttagggaaattaaagtgggcagtgatgaaactacagacaactcaatcattagacttaaagaaaaagctaaaacgttacatcctgatgagggcaatagaatctctggcaggagtagtaatagcttcaaagattctgcctcctgcattatcacaattgttgatgattctaattgaattcataaaacttattgggggttagcatgtctttatggaaaaaattagatgagaaagaaaaccaacgcacacataatttaagcaactctgatgcaaatgataggattctgagagttataaattctgcttttggagttccagacgatattaaagaagaagttattgcagcaatagacaaggcaattaaacacgggcttgaaaatggaactttaaactatctaaaagtcatagaattggcttgtgaaggatatacaaaagaggatattgcagaggcgtatgggcatcaaatattgggggcttacgttgcagttttaatcctaactggaaaaccacttaaattgaagtgattttatggactacaaacaatgggtgcgggaatttaaaaaagagttggctcatgagattgagaaagagttggttgctgaagttgatgacaatatacaaaggggttttcagaagaaagaattgaaatggaaaccattaagcaaagattatcaaaaaaggaaagaaaaggaaggtaggaacaccaaaggattaatttatcatggagcattattaaaagcaacagatagtaaggtgaaaatcacttcaaaaggtttgcaagtgaaagttttcaataacatggtgtatgctggagttcatgaatttgggagtaagaaaaagaacattccagcaagaccatttatacagcccgcattgaaaaaagtccaaaaagatttaccgaaaatcgtggaaaaagtcattaaaaggatgagatgatgtatatcgtcgaattagtgagagaatctctcaaaaagaaaactttcaataaaaaaatatttttagaactctgcaaaaagttagatattcccatacctcaaaaactgaataaacataacttccctccgctattctatgagttaattgacaaattaaaatcattaaatattatagaattctgtgaaataacaatggatttgcacacaataaccgaaaaacagaaagaaatattactcaatatggttgaacatcccattaatatattgattattggaaaaggtggcggtaaggacttcatggtttcattattgttcaattatatgatgttccgagcttgtgtagaagattattatgaaaaattcacaagaattgattttgttaatgttgcccccaatgaccatttagcaaagaatgtttttttcaaagagtttaaagcatggtttcttaaatgcaaagtatggcaaatgatagggatagataagaaaaaaagacaaaaagcccctatatgtgtattggaaacaaaagcagagataggagataaaataacaatgcactcaggtcactcaagagcaacatcatttgaagggatgaatgccctatgcgttgtagctgatgagataagcgacccagattttaaaaatgcagagcaattatttgaacaagggttaagttctgcaaagtcaagattcaaagataaagcaagagtcgtagcaatcacatggacaagatttccaactccaaatccgagagatgacgtaggatatagattatatcttgattataaggcagtcgatgaggcatatacattcaaagggaaaacatgggaagtgaatacaagggtttcaaaagaagactttaaagcacaataccaaaagaacccaatccttgcaagatgtatgtatgaatgcgaacctcctgaattgaacgcttatttcatcagtttagaagctctggaagcaaggcataaagtggaaatgggattattcacatggagggcaatttatgaaaacaatttgataagattggagtttaaacaacttcaaagcacagataaaaccatttactgccatactgaccttgcgattaacagagataagggcgtaattgcgataagttatttcgataaagggaaggttataatttcagacattattgttcttactccaacgcttggacataagattgattatttaagtttagagaagttttacaatcatttacaaaaccatttttcagttaaattcacatttgacagattccaaagtgaatattttatacaaaaattcaaaggtgaaaggctatctaaacacgtcaaactatggacaacattccaagaactcgtagaagggacaaaagaatactatgatgcaactggtgtaaaacggaaaaaagcaaaaatcgaaattcgatgcaatgaagatatttggcaaaaactaagaactcaaatcctccaacaccaaatagatggggataaagtaatctatttcggtgaaggtagtcctgacttagcagatgctgttgtctcaagtgcctataattgcattacccacaatgtgaatgcaattgatgaagaggattactcataccgccaagtgtttgacgatgaagaagaatttgaggaatttgagtttggaagtttcttttaaggtgatactatggaagatgataaaattcaaatggagactgttagtattgacttagcaaaagatactgctgtaaatatggcattgagaatcttattcactcaaatctttacaccatactcaatagtatcaattgatgggaagcaactatccaaagatgtaattgatgagatttcaggactgattgatagacacataagggacttacaattagcattttctgattttttactgaaaggaaaatgctacctctacaaattgcattacatcaatccgaattcaatgaactttaaggaaaggaaacattggaatccacaaaaaggaagatatgagtattgcatcacatacacaattaaaaggaataatgccgaaagatggtgggaagttgatacagaagaggatgttagggttgtaattgcaccaatggagctaagacaacactttcctgcggatgttgaattttatgatgaaaagtatttgggagtatattacaatccaataccaatacatgaaacaatccaagagattgcagaccaaaaaaacacacttgctttaaaagtattgccactcatggttcagaaaaccctaatcccaacaattatagggattactcaaaacactaaagcaggagagataataaaaaaggcactatcaaatcaccaaaatagaaccagagtatatattcctgcaactcctgatgaagtaaaatttgaaacaataagcataggaaaagacatcccaactgatttgatagaaacaatgctgtattactatgacagtgccatattcatgggattggggacttcaattagtattgtaaaagcatctgggcaggagctcacaacatcaaggactgtagataggaacatattaagaattgttcaagggtatcagcaggaaattgaaagatggattgcagaccagttagaaaaaatgggatacaaaggcatctgggttaaatttgcgaatccagaccctgactgggaaattaatatgttgcaaaaagcaaaaatggttgcagaattaaaggcacaagaacaggtagccaaatatgacttcagtgcattgattgaaagaatcttcccaagcaatgaatttggagaaatacttgcggcatatcctgatttaactgaaaaagaagttgagaagctattgaaaatggcaaaagagggtaaaggaggtttagaatacgcagatgaagaaaaacaaaaattattagaaaaaaagcgtaaaagtttggaaaaaataatcagcaaattagaaaaagtgggagataagttcggcaaaaaatcaatggaaaattttgtaaattggatacttgaaacgtatgaaaggcttggatataacgaacttatgcaagattgggatgaattattaagggaattcactcgagaagaagtggatatgttcttccttgactacgtagcccctacactcaattcattgaagatatatgatgacttagaccagcaaactattgatatactaaaacaacattgggaacaggcattctacaacatatattcatcatatagccaacagttccttgatgttcttacagagggaattcaaaaaggacttggtgaagaagaaattgcaaagaatcttaaaaaagttgcaaaagatgttaagggttcaagattgcagatgagggctcgtgaggagatgaacaaaacctataatctgacaagagcgagaaggttctggaatgacaaggtaatatatgtcacaatgaaagatgaaagagttagaccaagccatagaaaactgcatgggctcatctttgtacctgctgaaagacctgaattagtgccaccattaggatacggttgtagatgcacaataacacctgtgagggattaaaatgccaaataatacaaataataaattatgtaaagtctgcaactctccacacagggctgagatagaagcattatatttccagggctggggagctaaaaaaatatcaaaatatttaaaagaaaagtataacgaagacatctcatacagtgcgattttaaggcacatgcaaaaccatgtaaagcctcagctacttgaagcaatagaagaagaaactaccgaaatttactcaaaaatgtataaggagattgcgaataattttggattggctttggaaggtttatttacaatgattaaaaccgcaaaaaaagatttggaaaatccaaaggcaacagcgagggaaaaagaagttgctggtaggaatttagttatggccataagagagatgaaggagctattgcaacttactgaagataaagagggggctgatgacattgacctttaaaattgacaatggtttcggagggttgcggggggtttcactttcatattttttataagcaattatatttttatcttcaaattcatcaatatcttaccgtatcaaattttagtccagttatgcacaacttaaaaaatcatagtcctctaaaattttgttagagtataagtttaaaataacattagtttaatactggactatatcaaaaaagctctgttaggctgttaaatcattggcgcaggggctgggatttgaacccaggcggggcaaagccccactggatctcaagtccagcgccgtagtcctggcttggctacccctgctcaaaataggcatatgaaaaatataatgatttagtatataaattttacggtgtctcttaaaaaattatggattacttattttacttaattccccctcaataaataaagagatgtttttatcaacatcatctccttcagcatgataaatttctatttttttgctaaattttttgtaattctcttcacttatgtttttacatataattgcattaacgttttcttttacaatagacttttttccactttcatcattgaatataacttttgtactcttaacttcgttatcatctattctaacaattaagaaatacttacaatcttcaaaactattactaattttatcaacatccattgaaatggctactttcatatttatcaactcacaaaatatgatttggaaaataggagatataagataatttaaggttatttaaatactttaccccgaaagatatacaaatcttaaagcgaatattacggctaaaacatatacaagccaatgtacttccttccatcttccagtaaatacctttaagattggatatgttataaatcctaaggcgagacctgtagctatactaaatgtcaaaggaatagttagcaaagttataaatgcaggaattgcctctgtgtagtcatcaaagtcgatgtattttactgacctcatcattaaagctcctacaatgacaagtgctgctgctgttgcataggggggaattgccttaactactggatagaaaaataaagataataaaaacaacatagccacaactactgaaacaaaacctgttcttcctccaagtgctataccacttgcagattctatataggttgttacagttgaagttcccaagagagaaccaacaactgttccagtagcatcagccattaaagccttttcaacccttggcagttttccatctttatctaaatatccagcctgagaggctaaagcacttaaagttcccaaagtgtcaaacatatcaacaaagaagaatgccaagactattgtcaataaacctaagtttaaagcccccattatatcaagctgtaagaatgttggtgcaattgatggaggcattgagaatattccttctgggaatggtgaaattcctaaaatcattcctattagcgaagttactataattccaattaatatagctccaataacattcctactaactaagattgatgtcaaaaatatcccaaacaacgccaacagtgtagatggctccattaaattccctaatgtaactaatgtagctttactactaactatgataccagcactttttaacccaataaacgcaataaataaaccaataccaacagcagttccatactttatagcatttggaataacattaaaaatccatgttcttatctttgttaatgttaatattataaagagcactccagagatgaaaacagcacctaaggcaactctccaatcaattcccattcctaagcaaaccccataggtaaaataagcgtttaatcccattcctggagctaaggcaaatggatatcttgcatataatcccataactaaagttgcaattgctgaagcaatacaagtagcaaccataactgctccaaaatccatacctgcagtactcaaaatctgtggattgacaaatattatatatgccatggtcataaatgtagttattcctgcaagggtttctacctttagattagtcccatacttctcaaattcaaagtatttttcaacaaatttcataatcacccctccatttgttataatggtttatttatgtaatctaatgttttataaaatcttcaattaatataaaataataaggttatagttagctcttaaatagttaattctttagagagaataattgggctactaaaaaatattatggtgattaaatggaaggtttgacagtagggttatttggacatgttgaaggtgttggaaaagaattagggaagaaaggaacttcaacagacataactttatataattacaaacagggagataaggcagtttgttatgtagagccaacaagatatccagatagaataaaccctttaatatatgaaataaacatgatggactatgccttagtttttattgatgagattacaggagagttaggagagacacttttagcattggatatgtttggaataaataatggagcttttgttgttggtgaatatgttgatttagacatgttgaaaaatataatatcccaaacatcaatgaaggactttgaaatcttagagagagattttataaacattagggaaaagatgattaatttaaatattgagagagattataacggctttgttaaaattccaatagaccactactttactgttagaagtgttggaactgttatattaggaaaggttgagagtggaactgtaagagttcatgacaatttgagggtctatccaacagataaaatggcaatggttaggagcattcaaatccatgataatgattttaaagaggcaaaagctgggaatagagtaggtttagctttaaaaggaataactacagatgagttagatagaggaatgatactatcaaatggagagttaaaagttgctaaagagattgaaatcaacattaactggaacccattcatgcaaaaaactgtaaaggaaggggagaactaccaaataattgttggtttgcaaagtgtttcatgtgttgttgaggaagtgaataaaaacaaaataaagctttcactgcaaaaagaaatagcttacgatgttggagataagctatgtttaattgatggcagtgcaaaaattaggatattgggtgtcggaaaattatagttcttttcaaaatatttttgcaataactaagcactgatgaactccttcctttaggaaggagttcaaatttccttaataacttttattaacttttaaaaagaacagaactataaaaatagcacaatactaaaatattatatagtatcattatcacaattatatttatgaaatgttgagttaatcataagattcttgcataaccaaaagatatatataccccctatttaatacttatatcaccacaaattctgtattcttatattcctaccctgttaagttttaacttaacaccattttagaataaatataataaaaataaaaaagataaaaaagaaggtaaattggtgatgaaatatggcaaagcaaaaaccagtattaaacgtagcattcattggacacgtcgatgcaggtaagtcaacaacagtcggtagattattatacgacagtggagctatcgacccacagttattagagaagttaaaaagagaagctcaagagagaggtaaagcaggattcgagtttgcttacgtcatggacaacttgaaagaagagagagaaagaggggttacaattgacgtagctcacaagaagttcgaaacccaaaaatatgaagttacaatcgtcgattgtccaggacacagggacttcattaaaaacatgattacaggagcttcacaggcagacgctgctgtcttagttgttgatgttaatgatgccaagacaggaattcagccacaaacaagagagcacatgttcttagcaagaacattgggtattaagcaaattgcagttgcaattaacaagatggatacagttaactacagccaagaagaatacgaaaaaatgaaaaagatgttatcagagcagttattaaaagtcttaggttacaacccagaccaaattgacttcatcccaacagcttcattgaaaggagacaacgtcgttaaaagatcagaaaacatgccatggtacaaaggtccaacattagttgaagcattagacaaattccaaccaccagaaaaaccaacaaacttaccattaagaatcccaatccaagatgtctattcaattacaggggttggaactgtcccagttggaagagtcgaaacaggtatcttaagaccaggagacaaagttgtcttcgaaccagcaggagttagcggagaagttaagtcaattgagatgcaccacgaacaaattccacaagcagaaccaggagacaacattggattcaacgttagaggagtcagtaagaaagatattaagagaggagacgtttgtgggcacccagacaacccaccaacagttgcagaagaattcacagctcaaatcgttgtcttacagcacccaacagcaattacagttggttacacaccagtcttccacgcacacacagcacaggttgcatgtacattcattgagttgttgaagaaattagacccaagaacagggcaagtcattgaagagaacccacagttcttaaagactggtgacgcagcaatagtcaaaatcaaaccaacaaaaccaatggtcattgaaaacgttagagaaattccacagttaggtagattcgctatcagagatatgggtatgacaatcgctgcaggtatggcaatcgatgtcaaagctaagaacaaataaattccttaaatttcccttttaatagcttttaaatcccattttatatttttttaatattttaaagcatttgagaggggagagtatgcaaagggcaagaatcaagttatcaagtacagaccacaaagttttagatgaaatttgcagacaaataaaagagattgctgaaaaaacaggagtagatatttcaggacctataccattaccaacaaaggtcttgagagttgttacaagaaagagtccagatggagaaggttcatcaacatttgacagatggacaatgaaaatccacaaaagattaattgacattgatgcagacgagagagctttaagacacattatgaaaataagaatccctgacaatgttcaaatagagatacagttcaaataaaattagtgtggttattttaataaacaaaatttcataggcaaaaacgttgcaatctgaacaatgaggattgcaacgaaattccttttttaatataatttattcgtttcctgatgaattttttgattcttttccacttctgtatccgaaataataacctattatcgtagtaaccattccaaaaaatagtgagaaaatttctttattgttagagtatatatctggatttttggatatagcaatcaatataataaaaaatgctataacgatactgccagttattgccctcctcatctctcctttatctaatttcttattgtttatccatcctaaaaatacaagccacaacaaaacaagtgtaggaacaccaactgctaatactaaggtatcgcagaatataacagttagggatatgcaaataacagctattgaggttactattgcaacaattttgtcattatttgtcattttatcacaaccaacctattcaataattattctattcctcttaattttttaaacaatctaaccctctcaagaatctttttctttatctcttcaattcctttaccctctttcaatatggctgggactataaacttccactgatgccatggtggctggcattttaaatattcacagatgccatctaaaactgcatcccattcctctttctttatcttatccattttattagctacaagaatcgggctaatcttcaaatcagttataaagtcaaacatctctaaatcaattggaatttctcccctccctttccatctttcaactatctcaaaaaatgatttcgtatctataatttgaacagcagcagctatttcatcagcatgctcttcaatataatgaacaatctcatccttaatcttctcttgcactttttttggtagtccagccatgtaaccaaagccaggcatatccaccaaaatatactcccccatatcgtattcattaatttttaaagtaactcctggcttttttcctactctaatatcttttcttccagtcattaatctaacaaaagtggatttacctacattacttctcccaactacaataacttttggctttgtctttttttcttcatacttttcttttaaattcttatatctctcaaaaaagtccatagtctcacacaatttaatttggttttaaaattatctaaaataagtaaaaaagattaataccttagttattctaaaaagttttgaaagaccctctattaatgcctatcttgtggtgttctaacttcttcaataatctttttacctgcaacaacctcatctatactgtgaatagtccctcccaaactttcaataatttcctgaatctcatcaaaatctaaattattcccttcaattgtaactttaacattctcagtctctttatctatttcatagactgtaatattaaccccatcaatgtttgataatgatgttaattttaatgccatatctgttatttttggctcatgcggcttcaatatatctaaaacaattctcctaatgccgttcaattctatccctctaaatctttttaattgttatattacctatacttagattatttaaaattattgttgatatatttttatttatggatttatcgaatattaaaaaccaaatgataagatattaatagcccctaagataaactataattgttaaaatcttaatggagggaaactatggaaataaatggagtatatattgaagatacatttgcagaagcattcccaatatgggtttcaagagttttaataacagcagctacaaagaagtgggctaagattgcagctacagaggcaacaggttttggttgttcagttataatgtgtccagcagaagcaggaattgagaaatatgtccctccatcaaaaacaccagatggaagaccaggatttataatacagatatgccaccctaaaaagtcagagttagagcatcaaatgttagagagattggggcagtgtgtcttaacatgtccaacaactgctatttttgatgctatgggagacatggctgatgagcagttaaaggttggatttaagttgaagtttttcggagacggttatgagaagaaagatgaattatatggaagaaaagtttataaaatcccaatcatgggaggggaatttataactgaagctaagtttggaattaagaaaggagttgctggaggaaacttctttataatggcagatacaaacgcctctgccttaatcgctgctgaagctgcagttaatgctattgcaagtgttgatggcgttataactccattcccaggaggagttgttgcttctggtagtaaagttggagcaagtaatccaaaatacaagttcatggttgctacaacaaaccacaagatgtgtccaacattgaagggtgttgttgaagattcagaaattccagaagatgtaaatggagtttatgagatagttattgatggtgttgatgaggaatcagttaaagaggctatgaagcagggtatcttagcagctacaagagttaaaggtgttaagaagattacagctggaaactatggaggtaagttaggtaaatatcaatttaacttaagagagttgtttgaataaatttactctatttactttttaatttcttttttataatagagataaaaacaaaatttaaatagttgataatttaaattatataaatggctgtggaatttaaatttataaaaaccaataggaggtttttggtttgaagccaaaatatgcattaagaaaggatatgattggagaatttacactaaataaatcttttaatacttatagaggtaaagttttgaaggctgattttaacggtcccatagaaggcatcgtaatgaaaaacaaaaaagagcatatctatttctatcctcttttggcactacatatggttaaaccactcaactgtgttcccataaatgtcattccaaaaacttctctaccaacaaacccgaagaatgtgcatattaaagaggcattatcaagaattgttggtagaactttgaaggtttattatgagacaccaaaaacatcctatttgggaagattgttgggttttacaagaggggttttttcatggactttagttttagagatacatggagaggttgttttattgtttaacccagattatattgtttattatggaacaaagtggaagtttttaaaaaacaatcctccttacaaaccaccaagattaatgaacattacaaaaacagcaaactatttaaagagatgtttattagaggatgtaattatagagccagagtatccaagaataaatattgaggataaggtttttgtttatccttatggagttgtctctaaggatgattacttaggaaagacagtagaagatatattaaaagaaaaagagttcttaatttaaggataatcaataaataacaaacaaaatttattttaacacttaaaggtcttaaaatttttaaaattttcttttttgctaataccttcctaatctaatcgaaaatagttcataatatcctatttttttacataaaagctcaaaaaattttaatttatttcagcaccgaagagtttatatatgagtaatcattatttacactaaaaaatcttacatctattatatatactcgttcataaattgagaaaaacatgtgtttttggaggtgcgttgaatgaatgctgagataaaccctctccatgcttattttaaattaccaaacacagtttccttagtagcaggtagtagtgaaggagaaacaccactaaacgcttttgatggagctttgttaaatgcaggcatagggaatgtcaatttaattagaatcagcagtataatgcctccagaagctgaaatcgttcctttgcctaaattaccaatgggagctttggttccaacagcttatggatacatcattagcgatgtcccaggagagacaatatcagctgcaataagtgtagctattccaaaagataagagtttatgtggtttaataatggagtatgaaggaaaatgctcaaaaaaagaggctgaaaaaacagttagagagatggcgaagattggttttgagatgagaggctgggaattggatagaattgaatcaattgcagttgagcatactgttgaaaagttaggatgtgcatttgctgcagctgcattgtggtataaataattttcgaaaaacattaacagttaaatataattaagttataactattaaggtaaaaataatttaaagataatttttactttctaaaagtttcttacattaatttgtttttatttaccaaatttggaggtgaaagcatgttaaaatacttagggaaacacttaatattagagttatggggttgcgacccaaaggcattggacgatattgagggcatagaaaagatgttagtagatagtgtaaaagcatgtggagctactttaatttgtgtaagaactcacaaattctctcctcaaggagctacaggagttgctgtgctcgcggaaagtcatatagcaatacatacctaccctgagtatggctatgccgccttggatgtatttacctgtggagagcatacagacccatacaaggcattagaagttataagagagtttttaaaaccaaaatcaatacaaataattgatttaaaaagaggattaatggaaaatgggacttttgaacttaaataagctttttagcttttctttcaattctaaagttgattaattttttaaatttttctaaagagttggattttatgtatattcttcagaggtatccagatttatatctgttatttttctcacaataaactgaatactcaattcctaatttctctaagaaactacaacaaacatcaattagattcctgttagtgttcgctatactgacatatttatatacataatttccttttttgtttattacaactgaaccctcggaatcataaaatccttttagccaagaaatcattagtttttcgttatttccaattacattcatatagtaatctacattaagacttttataccaataatagaaaccttttgaacgaactcttacaacatattggtcttttttattttcaaatttcctaacatattcatttatgtatttgaagccaatgttttcaagatttcttttaaattcttctataaaatccttatctgtaacttttaattcaatcacataattactttcctgcttatttacacttccatctccatttaaaactcccaatatgtaagctaacgattctgaaggatttaaatttatttttttcgtatttttgattattaagctttcagatgattttctaatatcgatattattatttcttagaattcttcttatcgtttcatggctacacttcataatctttgctatttcagtagttgtatatccattttgatataacttaataatttcttgaggattcaaatctaaacctcttcttggagttatacctaatttatataatctgtaacatactgttgatttactacatcccaatatttttgcaatcgttcttgcagaatatccctttttatataattccaaaatttcaaatcatcaattttaggatttttcttacccataaatagcaccatgcaaaaatttttatagacaaaaggtttaattaacattactccatttataactattatatttacacctcctaaaataaataaggtgatgtagagtgaatcaaaataatgattttaaatgccatatttggtttacagagtatcataacaacaatgtagctctttcagttagagttaaggatatcttatatagggagaaatcaggatttcaagagatagagattattgacacctatgattttgggaaggcattaattttagataacacttttcagacaacagagagagatgaatttatttatcatgaattaatatcccacatacctcttttcacccatccaaatccaaggaatgttttggttattggaggaggggatggagggactgttagggaagttgttaagcataaatcagttgaaacagtggattttgtagagttggatgaaaaggttattgaagcttgtaaaaagtatatgccaaaattgagctgtgaaattgataatgagaaggtaaatttgataataacagatggaattaagtatgttgctgaaacagagaagaagtatgatgtgattattgttgattgtccagaccctgttgggcctgctaaggggctttttgagaaagaattttataaaaatgtgtttaaatgtttaaatgatgatggaattatggttcagcaatcagagagtccattgtataacttagatttgatacaaaatatctgcagatatttaaaagatgctggatttaagataattatgccatacacctacccaatgccaacatatccaagtggattctggagctttacattagcatctaaaaaatacaacccattagaagttgatgaggcaagaataaaagaagctttaaaagatatggaaactaaatactatgatgaagaagtccataagggaatatttttagcagcacctaaatttttaaaagatgctgttaaaaaagctcttgaataattttattttcgtcttttttatttatacactcatttcgaatttttaccattttaaccattttatttttaaatatttttaaatatgtgtttgactatctatatggttgatttttgaaaatatctaaaaatcgtcagagagttaatatatacttgcacattctttattacattatatgtaaaatatgacaaaaatccagaacgaaaaagataaaaatacgatacgacgtattaatagttccttgcagaacatcttagaataaatatataaacgtctttaataagaaggcgttcaaataggactttcgcagtttttatataactaaggaatttagatgtccaaagggcaccaatattctctaaaatatttatttctgcgattttgcagagaaatatggtgtataggactttttatagtaaggggttttaaacatgtattttataaaagtaaaaactataatacattcatataatatataaatgtaaatccaacttgttcaatattttataaaaatttgtattttttcgatatcttacataattatcctataaaaaaaattccsccccccccccccccccccccccgaaaaatccaaaaaaatcggaaaaaccaaaaattttatatagtcgattatattaactcatattattaacaaactatacattattaaagtctctctataggactttcacagtttatatattaagtgtttagatgtccaagggaatcaatcctccgaaaggtggagggactatggaggggagatacatgagtcaagcacatgaattattgacaaatacaggagttgagaatatggcaaatagaacagctgagagaatgattcctttaatgaactctttagtaactggctatagcatagcgttagcaaaaaccttaggtagtggagcaggagctatgactcaaatcttactatcagaaattggagaagttttaagtgcaatggtcgatgaaattttaggcagtgggcaagcaagttatgaattagaaaatgttgaagagttgttaaaaaatgcgttcttggagttagggattgctaaagatgtaaaaattgaaaaaaatataaaagataacatggtaatttacaaattgtatataaaaggttctttatttgctcctgtccataaaattttaatcgatagaggattaaaagagttcccgttaagcccagagggtttattagctgcttccatagttagaagagtcctaagagaaagaaaagacggaaatacaaaggcaagaattaatgtaaatacaaaacttccagttaatggagagacattgattgttgaaataaaagaagtagggagtttataatctttcaactttctactaaatttatataatattgaattctgaaatttatgatggttttcaaaatgttaaaattcttaatgctcctatgtatagggggtatataaataccacaaataatatttttttagaaatcaccataatgctcttatatataattctatatatactcctataaggtgttatcacgtaacaacaaagtatttattatatgaaagtctctatctaattaaaggaggcatagttatgattcaaaaagaaattcttgaagaattaaaagatttagattatattcatggagttttattaataaaaaatgatggattagttgaatattccagtttgtcagaagattcaaatatggaaagcttaggggcaagattatctatcattttgaacagtatttctgaagtaataaaagatatatataacgaaaagacagaatgtgtttttattaaagttaaggacgatggaataatattaatccctaaagataatgaaatattaacaatactattcaaagccaataatgacatcttacataaaattattccaataatacaagaaataataaaataagttgaaataaaaaatggaaagaaataaaaatgggatagtatgattgatagggttttgttggagttgaataagactgagggtattaagggttctatggttgttggtaaggatggtttagttattgcctctcaattgcctgggagtgttgatgctgagttagttggggctatggcttcagcagcatttggggctgctgaaagaacagcagcagaaattggaatgggtactttagaacaaacaatgattgaaggagagcacggtaaaaccctaatggtcgatgcaggagagggaattttagtagtcttaactgacgcaaaagttaatttgggtttaattagaataacaatgaaaagagcggcagataagataaaagcaatgttctaaaaaataaaaaaattaaatttatcaaattttaaacaatcttttttatttttaatgattaggatatatatttttatatgtgctatggtttttattcttcttttagtatattttctttgttgaggtggttaaatggaggagcactttattgatttatctaaatttatgatggcaaattgtccttatgaagaagctgagggagttatattttcaattccctatgatgaaacaacctcatttaaaccgggagcgagagagggaggaaacgctataagaacagcatcatggggtttagaaacatacagcccaattttagatagagatttggcagaattaaaatactgtgatttaaaagatttagatttgtatggaagtcaagaagaaatatttggcacaattcactcagtctcaagggaaatattaaaagaaaataaaaaaatcattgtttttggaggagagcattctataacttatccaataatcaaagctgtaaaagacatctatgatgattttattgttattcaatttgatgcccattgtgatttgagagatgaatatttgggtaataagctctctcatgcgtgtgttatgaggagagtttatgagctaaccaaaaatatattccaatttggaattagaagtggagataaagaggaatgggaccttgcaaggaaaaacaacctctatctaaagatggatctaatgaataaggatgatttagaatatataaagagcttagacaagccaatatatgtaactatagatatcgatgtgttagaccctgcctatgctccaggaactggaactccagaaccctgtggattttcaacaagagaactttttaactctttatatttattagaagaggttaaagataaaattattggttttgatatagttgaagtttctccgatttatgatattgccaatattacagcaataaccgctgctaaaatagcaagagaacttatgttgatgattctataactaattttgagcatatgtgttaaagttatatttttctgcttatacttctaattcatatgattttttattgtttttggtgaaaggctatgatatgatttaaattttttgtgatttggaattaaatcgaaaagtatatatactggggaagttaataatatagttcgtaaaacatacacaaccattcacaggtgagattatggatgttaatgaaataagagaaaatgcaaaaaagttaatggaattgatgatgttagataaaccatttgtcgctgtaaaattggcaaaatcaaaggaagaaattccagaaggctatgaaacattagacgaagaaaaaagacactgtgaaatgattcaaatggcaagattagaaagaaaaaaattatatgcaacagttgataaacacctctgtaagggaggagcttatgcaatgggggtctttagaaacccaccagaaccattagcaacaggaaaattatatgtcaaattaggaaactttaaagatgaagaggcagctaaaaaaacagttgatgcaataccaaaagttgaagaggaaatttatgcaacagtctatgctccattagatgaaaccgacttcattccagactcaattgtatttattggagagccattatatgcgttgaggttagttcaagcaatactctaccataaaggtggaagattccaggcagatttctcaggaattcagtcattgtgtgctgatgctgtagcggcagtttatacaagaaaagctcctaacatgactttaggttgtaacggttcaagaaaatacgctggaattaagccagaagaagttgttgtagctttcccaccagagaaattgaaggatattgttgaagcaattgaacacttcagacaagtttggacatgtggtcattaatttttagcctataatttaatattctatttttggaaaactatttataaaaatttggataaaatttttattataaacttaagaggtttttaaggtgttagtatgtcaaaggtaaagatagagctttttacatcaccaatgtgtcctcactgtcctgcagctaaaagagttgttgaagaggtagcaaatgaaatgccggatgctgttgaagtagaatacataaacgttatggagaatcctcaaaaggcaatggaatatgggataatggcagttccaacaattgtaataaatggggatgttgagtttattggagctcctacaaaggaggcattagttgaggcaatcaaaaaaagactataaactcaaaatttttaatttagtgaaggttatgaagctaagagtagtttgtaaggatgaaaatcttacagatgatgagctctgtataaaatgtgagctctgtattggaaaagatttaatgacgattatagaaatgatgaatgaggaatataagatagatgaaattatcattccaaattgtgagacattaaaaagaattttaaatatggattaaaattctcaaatttctcttttttattttttatttttagaaccttatatatttgaatattgtctccaattttgtcatctggtagccaataactgcccctatagaagctggaactgcaaaatcaaatccaaaaatctctgtgcataacactgctcctcccaatggagcatttgtagtagcagataatgttgtggcaatacctaaaactatataaggagcagaacaatctcctattaaacttccaaatataattccagaaattgctcctatacacatcgatggaaaaaccaatcctcccggagttccagagccaacagtaaaggaagtagctaatatcttacctattaatagtaataccaaaaataccaaagaaaattccataataaacagttcttttgttaatgttaaacccatgcccataacttctggtataaaataacttattactgcaactaaaattccaccaatcaatgtcttaatgcagtaaggaattttaagattatcgaaagttgaagatatttttctatatgtttttatatagcagtgtgcgattaaagagcagaaaaaagctcctaagataaataaaagaaaatcgtgaatgttgatagtataggataaggtaatgttaaataaatgttttcttcccgttattaaataaaatattagataaccaacaacacttgcaataattggaggaattaagttaatgtaattaaaattctcatgttcaataatctcacatgccaatatggcagtccccaaaggggcagaaaacgctccccccaaccctccagcaattccagttataataaccaactctctatttttcagttttaataatctgtaaagctcatctgcaaaagaggcgcttgactgcacacacggcccttcctttccagcactacctccaacagctataactgctccagctaacaaaacttttaaaagtcctcgaatccatgtcaatttttcattagtattcaaagcttttaaaaccctgtcaatcccagaaccctttagttcataaatataatcaacaaacaatccagcaataaaaaatactattggaattaataaaacattatgcttttctggaaaatattcaatgataatagctataataactgaacttagccctccaacaatccctattagtgatgcaataccaatccattttattattttaatatatttaccaaacatattaacaatattcatgggcattcacattttttatacttttttaaatgttatatgtagtttgtataaagataaatatctaaaaataacataaaaaactttttggtgaaataatgatttcaaaaaatgtaaggatagccaaaggggctgtaattgttggggatgtgactattggagattattcatcagtttggtataatgctgttattaggggagatgtagataaaataataattgggaattactccaatatacaagattgctgtgtcgttcattgctctaaggggtatccaaccataattggagattatgtatcaataggtcatggagcagttattcatggttgtaggattgaagataacgttttagttgggatgaatgccactatattaaatggggctaagattggagagaactgtataattggagctaatgccttagttactcaaaataaggagattccaccaaatagcttagttttaggtgttcctggtagagttgttagagaacttacagaggaggagattaaaagcataaaagagaatgcattgagatacgttaaattatctgaaaccttagaaagttataaataaaaattaaactaaatagaaataacaaaaatcctttgaagtaaaaggtggtattgatggtaaatcttgggtttgttattgctgagttcaacagagatataacatatatgatggagaaggttgctgaggagcatgctgaatttttaggagccactgtaaaatataaaattgttgttccgggagtttttgatatgcctttagcagttaaaaagttgttagaaaaggatgatgttgatgcagttgtaacaattgggtgtgttattgagggagagacagaacatgatgagatagttgttcataatgcagcgagaaaaatagcagatttagctctacaatatgataaaccagtaactctcggaatttcagggccaggaatgacaaggttgcaggctcaggaaagagttgattacggtaagagggctgttgaagcggctgttaaaatggttaaaaggttgaaggcattagaagaatagtgtcttctaaaattataaaaaatttttatgaaattgaatgccttccaaagaaaggtgttcattagtgccttagttattacaaaatgttttgaaagacactatggataagggatatctatgattttagaggaagtttatgaaattataaaacaaagaataaaagaaaagccagaaggttcttatgtggcaaaactaacaaccgatgataaaaaaacggcaataaacaaaatctgtgagaaaattggggaggaatctactgaattaattttagcagctaaggatgacaagaaagatgagattatttatgaggctgctgatttaatattccatactatggtattattggcttataagaacatagagtttgaagaattattaaaggaatttgaaagaagaaagaaatgatacaatctttttttatttttaaaactgaatcatcaatatagcaggaggatgttaatgaacattggaaaagttgataacataaagatttataccttagctgaggattatgcaggatataatagcccattttggagccaacatggcctttcttttttaattgaagtagaatccaatggtattaaaaagagaatactgtttgatacagcaacttatgcagaaccaattctcttcaacatgaaacttctaaacatcaatccaaagagtatagacatgataatcctttctcataaccactttgaccatactggtgggttatttggcattatgaaagagattaacaaagaaatcccaatatttgcccatccaaacatatttaaggttagctttgccacagaaccagaatttatgcttgctggaactcttaataaaacattaaaagaagatattgaaaaattgggagggagatgggttttaagtagagaccctataagattaatgcctggtatctttacacttggagagattgaagatgaagaaaaaataaactttgagaaaaagccaacaattggtctctataagcttgaaaatgggagagtagttttggataatgtagaggatgaaataggattggctatagttactgaaaaaggtttaattatcgttagtggctgttctcatccaggaatagttagtatggtgaaaaaatccattaaaataagtggaattaataaggtctatgctgttataggtggtttccatttaatagatgccgacaatgaaaggattgtaagtacaataaaagccctcaaaaagttgggcgttaaaaagatatgtactggacactgcactgggtttaaggctgaaaacatgtttatggaagagttcaaagaagattttgagaggttacatgctggaaagattataaaattttaaaacgatagtgtctttcaaaacattttgtaatataaaagacactaatttaaacctttgtaacaaattcccagaatgatttaacagcacttggattttttggtcttctacttttaactaaatataaatatctaacaacatccaaatctacaactggaactatcttaattaatccagcatcttctgcctttttagcagggatttctgaaactacgctaactccataaccttcagaaactgcagttataactgctgaatgactacccaacctcattacaacgtttaaatccattattgaatatcccttatcatttaaagcctttataaatgcctctcttgttccagaaccctcctctctatcaatgtaatcctctttaagtatatcctcaagcttagcagtgcctttctctgcaagtggatgatttggtgggacaattaaaaccaatctatctttacctataattgtatattcataattcttattttttagataaccaactgctgctatatctgccaatccttcatctaaagctttaaaacatctctcagagtcagttattgtaatctcaaaatcaacatttttgtatgagcttttatactccttaataattgatggtaatatatgctctccaggggttgtagaggcataaattctgataattccctctggattttcatgtatggctctcatcaacaattttgcctcatttaacaagtctaaaatcttttcagccctttcataaaatatctttccttcaggagttaaatcaactccctcaggagttctcaaaaagagttgggcatcgaagtatttctcaagtgctgatatgtgattactgacggttccttgagtaattcccaatctttttgctgccttagaaaaactttttgttttacttgcaactataaatgtttgaaaataacttatttttggatccatattattatcacctatgttacttaatccctattagaataactaataattcctatatataaagttaatgtgtagtgaattttaagtaccaatggaatagtaagtataaatataaaaaatctataataaattattgagagaaaatagcttttttatagtgctttccaaaacttacactcaaagcatatatatttaaattagttgtagatgacaacagttacaggattagatttttatatctcctttgtgttttaaatagtcgtaatttcccgaaactacttaaagttaaatttatatactaattatcccaactaaatataaatattaaagattttaacaaaattcaaaaaacagggtgagcagaatggaaaacaacaaagtaacaatcagtgttataaaggcagatgttggaggtttatgtgggcacacattagctccagatgagttgttggaggcatgtgaggcagttttagaggaggcagttgatgagattatattagattattatgtcacaagatgtggggatgacattgatttaattatgagccataaattaggttgtgataatgaaaaagtccatggattagcatggagggcttttgaggaggcaacaaaagtagctaaagagttaaagttatatggagctggacaggatttattagctgacagcttttcaggaaacgttagaggtatggggcctggttgtgcagagatggagtttgttgagagaaagagtgagccaatagttgttttctgttgcgacaaaacagacccaacagcatttaactacccattattcaagatgtttgcagacccattcaacacagctggtttggtctttgacccatcaatgatttctggattcaaatttgaggttcatgatgtcgttggacacaaaaaggtctttttagacactccagaagaaatgtatatgctcttagctttaattggagattatgagaagtatgcaattaagagagtttatagaagaagagataacgaaatagctgctgttgttagcacagaaaaattaaactacatagctggggagtacgttggtaaagatgacccagtagctattgttagagctcagagcggattcccagcagttggagaggttttagagccatttgccaacccacacttcgttccaggatggatgagaggtagccattgggggccgttaatgccagttggagaggaggatgcaacacctacaagattcgatgggccagcaagaattattgccttaggattccaagtttgtgatggaatgttaatcggtcctaacgatttgtttgcagataaaggattcgataaagcaagagagaaagctttagagatggcagatattataagaagaatgggtccattccaaccacacagattgcctgcaacaatgatggaatacacaacagttccaaaggtcttagaggcattggaggatagatttattcctttagaaggtttagagttgattgaagaaggaggaatcacaagaaaagacagaggagatgtggaataaaacacataaactcttttaattttttaaaatactttttgcaaactcttttgcttttttaatatcatcttcatttggatgatttttatttaaaccaccaaataatttaaagatgccataggtgtggtaacctttacagcaaaattctccaagaatttcaaatcccttacttttaagtttatccctaagctctttatggaacatgctttttaaaaaaggaaagccggctgtggagaagataaaggcttttttatttgttttactaatcttatctaaaaatttaaatattgatttatgatgttttccaaaataaattccagaaccaaaacctataaggtcatagttttcaattatatccgggcttactttatcaatattgtagatatcagcatttagctcatcggctattgtcttagctattttttcagtatttttatgatgaatggatttgtataaaattagagctttcatggtaactcctccttaaagcataattaattagttctttatttactaaatttttactatttttattattatcagaaactttaatacttagtaaggtttaaatattaaaaagttaagataaaactatcaaataattgatgaaatatcgccaaaaggatgacaaaatgaactttgaaaatgaaaatgcattatttaagaaggcattggaggagaaagagaagggaaattatgacgatgccatttattatttagattgggcttctcttatagcttttgctaaagggaatctacaaaagattaaagaaattgagaaaatactttctgaattggtagaaaaaactgattatttaagtttatatgccagtttttttattaaaataaccaattcaatacttaaaaaagaaaaacttcccaataacataattgatgaattttttgaagcaatagaaggaattgaagaaaaagataaagagtttaaatttgttgtaatggcattaaaaagaatagttaattacatggaaccaatgaatcaaaaagttcctgaatggatttatgaatggattgaggataaagaggagatgattaaagaagtagagaaatttaacccagaaaaagacaaggttttaattcaatctaaggattttaaaaaaggttttgttacggggacatttataggtggagagttggacaaatcaaaaatgaaaattgttgaaagggctaaaatgatgtttggaatcatagaagttgatggagcagttatagaaattccattaatggctatgaatttcactggaggaattttcagggctaaaggagttaaaaatgaggaacacctaaataaaataataaaaactattgaagatttgatgatagatagctatttctattaaaaaataagttgttggttatattttgtttaatcctttaattcataacaatttttccttataaacaattccctcatgtccagtaataacattttttctcagttttctaattttctttaaactctctaaagctaatttttcatctacattcaactttggaggaatcatctttagtatattattttttaaaggagatgcatctcctacaacaacataatctttataaataaccgatatagagccataggtatgtccaggagtttcaataatctcaatttctttatctttaaactttttaaaatcttcaaagttatcgttaaatccaaactcttttggtgaggcataaaatgtagcgtttttaaatattgggttgttttctatatggtcataatggagatgtgtgtttataactacatctatatcatttggagatagatttagttcagataagcctttaataataatattttccatatcttttgttgaagtatcaacaattatattgttgttgtctgtaataattaacgttgatgaagatgaggccttcttaattattccattttctctgattaaaatcccttcatataggagttttatcataatttcaccaattaaaattttaaatagaaatttaaacatgctaatatatatcaattaaggggtttattatgattaaaaaggtgaagataaaaaagtttaatggcagagatttttatgatatggaagattacgtggctgttgaagaaagctataacatttttatcaatggagagtttgttaaatctttatctatgtcaccaaattttttaaatgagtttgcagttggctttgccataagtgaagggtttttaaacaaaattgataaagttgaagttgataaaaacaacataaacatctttggagaaaagaatgatagagagattaaaaataataaaaataataaagaaataaaaatagacattgaaatcattaaaaagataatttcttatgaaataaaagctaaatattgggaaataactggaagttttcactgggcttcaatgtttgatttaaaaggcaatagtataatttttgttgaggatattgggagacataatgctgttgataaagttattggttatgcaatattaaacaattacaacttaaataagttaatattgagatatagcggaagaattccatctgatattgttaaaaaagctataaacagtggtttaaatattattatctcaaaatccccaccaacagataaagccatagaattggcagaggaaaataacatcctattaattggctttgcaagaaatgggaaatttaacatttacacaagtgggagattatgggaagagtagagtatttaaaaaaagagtattctgatgaggaaatctatgaaatcttagagaaaccagtaaaagaatggtttaaaagaaagtataaaacctttactccaccacaaagatatgcaattaaagagattcatgaagggaagaatgttttaatttgctcacctactgggagtggaaagacattatcagcttttttagcaggaataaatgagttaataaaattatcaatggaaaataaattggaagatagaatttatattctctatgtatctccgctaagggctttaaataacgatattgagagaaatttaaaagagccgttaaaagagatttatgatgttgctaaagaaattggtattgagttagatgaaattagagtagctgtaagaacaagtgatacaacaagctcgcaaaagcagaggatgctaaaaaagccccctcacattttaataacaacccccgaatcattagctattgccttaaactcaccaaaattctcccagttattgagtggaattaaatatgtaatagttgatgaaattcacgctttaacaaacaaaagaggagttcatctctcactttctttggagagattaaataggatagctaactttataagaattggtttatcagcaaccattcatccattaactgaagttgccaaatttttagttggtaatggaagagattgctatattgtagatgttagctataaaaaagagattgagataaaggttatctctccagtagatgattttatctacaccccttcagaggaaattagtaaaagattatacaatttattaaaaaaactcatagaagagcataaaacaaccttgatctttacaaatacaagaagtgctactgaaagagtagcattttatttgaagcagttgggagttgagaaagttgaaacacaccactcatctttaagcagagagcataggttagaagttgaggagaaattgaaaaaaggagagattagggtttgtatctcatcgacatcacttgaacttggggtagatattggaagtattgacttagttattcttctcggctcaccaaagagtgtttcaagagctctacaaagaattggtaggagtgggcataggttacatgagaaaagtaaggggattataattccatttgatagggatgatttagttgaaaacgtagttttagcttatgatgcaaaaattgggaagattgacagaattcatattccaaaaaactgtttggatgttttagctcaacatttggttggaatggcattagagaaggtttgggatgttgatgaagcttataatttaattaaaaaagcctatccatataaggatttaagtaaaaaagatttcttagatgttttaaattatttagctggtggaattgaagaaaaaaatgtctatgcaaagatttggcttaaagataacaaatttgggaagagaggaaaaagtgttagggctatatattatatgaatgttgggactattcctgatgagacagcggttgatgttatagcagatggcaaatacgttggagaggttgaagaggagtttgctgaaaagctgatgaagggagatatttttgttttaggaggaaagacatacaaatacttaggaggtagaggaaataaaattagagttaaggaagtttttgatgaaaagccaacaattccagcgtggttttctgagcagttgccattagcttatgacttggctttagatattgaaaaatttagaaaggaagttttatcttcagatatagaggaaattagagaaaaatatgacatagatgaaaaaacagctaaggcaattaaaaattatatggatgagcagaacaaatttgcaatagtgcctgatgatgaaaaagtgcttatagagaattttgatgaggaaaagagaagatactatatatttcactttgtagctgggagaagggctaatgaggcattagcaagggcctttgctaattatatctcaaaaataaagaaatgtaatgttagaatatcggtgaatgattatggcttcgctttaatactaccaaaaaatagaaaaataaagagagctgatataactgaactcttcaacttagatgttgttaaaaatgtaaaagagagtatagaaagaagtgagattttaaagaggagatttaggcatgttgctacaagaggttttatgattttgagaagatatatgaatagaaaaatcagcgttgatagacagcagtttaatgctgagatgcttttaaaatactgtaaagaggttaatcatccattatatagagagacattgagggaaattttagaggatagcttagacattgataatgccttagattattttgaaaaaattaagaggaggaagatttattatttagagttgccttctccttcaccatttgccttcaatttggttgtttcagcttcatcagatgtgatatttatggaagataagaagaagatgattgcagaacttcataaaaaagttatggaatttatttcaatgaaaggaaagaaataaataggagaggttgtaagttagtgatttcacccaattgtagaacattatgaagctttttatccaactaacaaccgtatcgaatttactattacttggaaatctatttaaaacctctttaatcttgtgataataaattctaaccgattcgtggcttatgtcttcgaattgggaaaggaataaacttaccttccttaacgataatccgaggtagtataaaagccctgctaagattttaacctctatcgattcctattccttttaaaaagcttcctctctacgattttctcctttataacttctatcatgagcctcatattttattatttttttatcaatatttaataaaaacttaacttgatagtctctatacaattaatgaggtatgttttttaaataacctataatctcattatgaacctcttctactgacttttttgttgtgtcaataactataaaattatattcttcagctaactctaaatatttatcctgaactttttttaaaaaatcttttttttcaaatatgtcttttgttttaaccctctttaatgctgtctcaatatcaacaattaataaaaaaacaatatctggctttagagcatatctgtttattgattttataaaattctcatcaactcctgcaacactttgataggcaatagatgagtatagatatctatcacaaacaacgtctctcttttttaattcttcttttattaattttgtatgctctattctatcagccgcaaataacaaagctaaggttttattatccacttctgtttttccagataaaatttctcttattattttccctactaagctatttgatggctcataagtccaaaatgcatccatttttttagctaaaagctttgattgtgtagtttttccactaccatctataccctcaaacacaataaacatgttatccaccaaaaaagttatacatccaagggttttgctcctattgatatgctctcaaatctttattaaagtgaggttgtcttggcaacctcgctcgggtatcccaataggggttttccccatggcaatataagcctattatcaccaaaagttataaataagatttatcattattaatcattataaattcctaataagttggtgatgcttatggaacaatttattggaattgttaaagatattcttgttcttatcgcttcatttggtattttgttggcttcttatagattatggatagaaaaagatagaaaaaacataatttatgcaaggatacatattttaggtgttattgactgtgcatgcttcttaatttttatagctttgggagaaactcttttagcgtttgtttatctaatcttagctccattcttagctcatgcaattgctcacgcagcatataatgacaacttgtccgaataaaaattttttaatattaaaactctctttcagttgaaaattcaaactcttcttctccaaacaatttcctaaccatccagtcagcatcaaattctattaaatcttgatacctctgtcctactcctaaatataaaattggttttccaattgcatagcctattgatagagccgctccacctttagcatcagcatctacttttgttaagataattccatcaatattcactgctctattaaattcttctgcctgatatacagcatcgtttccagttaaagcatctccaacgaatataaccaaatctggttttgtgactctaaccacttttttaatctcttccattaaattaacatttgttgcctgtcttcctgctgtatcagccaaaacaacatcaattcctcttgcttttgcatgttgtatagcatcatagataactgccgcagaatcagctcccggcttatgcttaataaccttaactccaacgtttttagcatgctgttctaattgctcaatagctccagctctgaaagtgtctccagcggctaaaactacgctataacctttctgctttaatttatatgctaatttagctatagttgtagtttttccagttccattgattccaacaaatacgatgactgttggttttccttctgctttattctttttgattatttcttcaatatcaattttttcttgggataatatattttttatagcattttttactgcgtttattgtaatctcttctacgttatcatctggagagatttttcttccaactaattcatttttaatattttcaattagcttttcaacaacttctaatgcaacatctgcctctaagagtgctatttctaactcttctaagacatcttctatatcttcctctaagataacaacttcttttttaagaactttcttaatagctcttgttaagccaaatctatcaaagaacgttatttttttctcctctttttcttctttaatttctttaatttcctctttagcttcttctactttttcagaaggttctgtttttacaatttcagattttttaatttcttcttctgctttttctttttttacttcttcttttttaggttcttttttaaataaacttgtgaaggatatttttgatttttcctctttttcttctttaacttcttcagcttctcctttgctgtatattttttcagtaatctttgatgcagtttctaagagtttttcttttaattttccaaacatttgtaatccctcctatgccgatatataaatattaaatttgaataaagcattgttaaagtaattttaatataataaaattacgaacaatatttatatgtaatctctgttctgtttgcgggtcgttttggggtgaaactatgaaatgtatttcaaaacaaggagaaattaaagagttaattaaaaatggtaaaataaatgatgttttacaactgattgaagaagatacattattgttagaggaaatttatggttttttaaaatctgatgatattcaattaaaaataacttgtttagctattttaggaaatttatatctaaaaggaaaagtccaaattactcaactaattaaacatttagaagaggtacttttagaaaatgacaaagatgctattttaaatgcccttttaattctaaaagaaattcctgaagtgtatcaggaggacttattgaaaaggataatattaaaatatattggaaaagatataaaagattgtgaggatgataaagataaaagtactttaccaagtgtaaagcgagacaaaataatgataatatttgaaatcttaaaggctgtaaagaacaaggaattaaaaaagacaaaaataatgtatgctgcaaatttagattggaaaacatttcgtaattatataggatacttgttagataatgaatttatcagaaaaacagatggggtttatacattaacacctaagggtgagttattattggagaaaattgaagaagtttttagattaatttatccagataaataattgccttattttcttttttacttttcataaaaaatttaaaaactaaatggattaacacatctgttttttccacatgctttacattcataaatcatattaacaaaatacacaatatagtataatcagaagatgtgggggaggtgataatgagggtaagtcaagtattacaaaaattgaagtctaaaactgctgggtgatgtcaaatggtagtagatggtagcattatacattggttgatttatttaatactctcaataattgggggaggttttccttgctaataaaatttaagaaatttatgaggtgtttgaaatgaaaaattctacgaggtatatattatcgctgctactctcaataatcatgggagttgcagtaatgggttccacatttgctatttcaacaacttatggaacaggacacacaactgcaactgtagacaaccttaagcctgtagttaattgtagcagttacgaaatggtaataagaacagttcaaggaataaaagtatatgaatataagaatacaactggagtaactcctggtcttttaagaagtgacgctttagaggcttatgcctatactggagaaggagtaaccttctatgtaaatgttagcgaccctaacggggagcaagatttacaaacaaatggagctggagtagatttcttattagttccacaaggacaatctccttcaaatccaacatatgtaatccatgcaggatttgacacatcaacaagtggagatgctgatttaacaaccttaacattctacgcacaatggacagtccctgcaggcgcatacggatgcttcgatgtctatgttaaagcaacagacaaacatggtgcatgcacaggatacatcaagaaaggtaagatattcttgaacccaatgattggaataaacgttacaaaagataacgatgcatatcctgctccattcacaggattaagcttcggtaatgtaaatccaggagatactaatgtcccagcaactgagaatgttgtaacaatccacaatattgacccagatggagtaggaactaagatagcagtattcgtttcagcaacctcaatgacacaggcaggaggaactggaataattccagcagagaatatcaaagcacatgttataaaagcaaacaatatgacacagagctacaatactcacctccaaaacaatgtcaaagttctattatggcaaccactcaaaccatgccatacaaatgctttagaagttaatttcacactcgatgttccaacaccattaccaagcggttgctatggaggttcaattacattctatggacttggattataaatcccccaactttttaattttttgatagtaaggtgattacttatgaaaaaattctctgcaatttttggtttattatctgtcatatttgtcattatggccatttcacaggttagtggtttaagtggggcaataactccaccaaaaattgatatcatggtgaatgcaagcaatgggcttcctcaagatataaatagcattatttatgtaaaaaatcccaatagtttcccagttaaagtggaaatggttacaactggagatttaaataattctaaaaaagtagaagtcaaaattatgaagaataactttacattaaaaccaggagaaactgttggggttaatatcacatttactgtaaaggaaaaggacaactatgaaggagatattttaacgaaaattagtccagtagattatggagatgataaaaaaggcgtgaatctaaaagcgagtgtagttttgcctacaaaagttgcgataatggtagttggtaatgagattcatacaaaagaattggtaattactgcagttttaatcatcagcatcttgggattaggtgctatgttgattaggagacatctctaattaaacttcatttaaacatttaaataaaaataaaataaaaatgttttaaagtggtagtatgaggattccccctccactctcaaataataaaaataggaatagaaggtataaaaggtctcaatttgaagtgatttttgaaattttgcatattatcaaggaaggagaacaaataaaaacaagaattatgtatgctgcaaacttagattggagaaatttttccaaatacatcgattttttgattagtaatggatttattaagaaaaataaagagaaatttgaactcacagagttagggaaaaagttgtattcctcgctgtatgaactatttgagattatgaactccaagccttaaattgtgaggggatttttatgaaaaaatttggaacggttttgctttctgatatcgttaaagaatgcttgagtggggatgagtttgcaagagagatgatggaagatttgttcaattttctaataaaactacgactttggagatggaaatacttgctctctcaaaatcaaaaaaatgaaatacagatgtcagatttattggccctaataaaggaagaaaaagagggtattaacaggttgttttcattcctatatcaaacagatatccctgttgagaatagaattgaaatattaatgttgttaaaagaattcgtgaaagaagaaattaaatggatttcaatggatgttagtgaaattaattttgtaaaaaaataacggcttttttaatttacctatttttatattgtttgatgttttttttatttacagttgtattccataatttaaattaatagattatagaaaagtttatatagaacttcaaaaacattacatatatagaaaaccaaaaaagagaggtgggggcaaatgttcggaagagacccatttgattcattatttgaaagaatgtttaaagagttttttgcaacaccaatgacaggaaccacaatgattcaaagctcaacaggaatacaaatttctggaaaagggttcatgccaatctcaattattgaaggagaccagcatataaaagttattgcatggttgccaggggttaataaagaggacataattttaaatgcagttggagatacattagagattagagctaagagaagcccattaatgataactgagagtgaaagaattatctactcagaaattccagaagaggaagaaatatatagaacaataaaacttcctgcaactgttaaggaagaaaatgcctcagctaagtttgaaaatggtgttttatcagttatattaccaaaggcagaatcctcaattaagaaaggaatcaacattgaataaattggctaattttctttatttttatactaaataacatctatataattacatatttagatggtgaagagatgataaagaaaaagcatttagaaatgatgttagattctttaaaaagacatccaaatccaaaagctgatttagagcaatatacaatagacggaaaattagcagctgatattttattttttgctgtgaatgatttttataacaatgttgttatcgatttaggttgtggaactggaagattagctataggtagcaaaattttaggagctaagagggctattggtatagatatcgatagggagagtattgaagcagctaaagagaacgctaaaaagctaaatgttgatgtagatttttattgcatggacattagagatgttgatgatgaatttttaaataatgtgcttggtgaagatagggatttaaagagagtagttattcaaaatcctccatttggagcccagaaaaaacatgctgatagagtatttttagataaggcgttagagattggggatattatttatactattcacaattatccaacaaaggattttgttattaagtatgttgaagataaagggggaaaaataactcacatctatgaggcattttttagaattcctgcaatatacgagtttcataaaaaaaaggttgtggagattcctgtagtgatttttagaatagagaaattagggttcgaaacagtttttaattttctataacttacagtagcatatcataataaacaatatcacaatataaatattgtttttttattaaaatagtaatatgtattgttatatcataatgttaatgaggaggctttgccttcgagacgaaatgttgatactaaatattaacgaagtttggattttggggctgtatctgttcagtcctaagtctgatgaacttatagtgaagggaatggtgttcccgatgaagctatgggctgaggacaacccatttccatagcttaccgattcgtatagtaagttattaaatgctatggtaagctatggaaacgggaaacggatagagactatattaaaaaatacttcccagaatgtttaaaatatattgaatgagaaattttattcttttttaccttcgaccttttcaacaattcttttaacaatctttttaaactcttcacttgctttacaatcaagtaaaaccattggaattcctttatcacttgcttctcttgctttaatatctaaaggaattctacctaaaaattcaactccaagctctttagcagctttttctccccctcctctaccaaatatatccacaactttattgcagtatgggcaaacaaacccgctcatattttcaataattccaataattgggatgtttagcattttagccatcataatggattttttaacatccaagacagaaacttcttctggtgttgttacaattatagctccatcaatatctggaattgattgcatgatagttaattgctcatctcctgtccctggaggagtatctattaataaataatcaagttctccccaaactacatctgatagaaattgcctaatagctccgctaacctttggccccctccaaataacaggagttttgtcatctggtaatagatatccaatagacatggtttttattccatcttttgtaactattggaaatattccagctggtcctgccataggttgggtgttctcaaccccaagcatctttggaatgttagggccgtgaatatccgcatctaaaactccaacctttttgcccattaaatttagagcagcagctaaattaactgttactgttgatttcccaacccctcctttaccactcaaaataactattttatgttttatttttgacatattttctctaatttttgcatcttgctgggctaagagtttctttgtatctgggcaggtattttttgatggacaagtgtcacattttccatcacactcagccatggtctcacctattttccctcatttgagtaaaaataataatcaatgaataataataaaagagggcatataaagttatctatttccatgtgatataaaattacaccccatataaaggatgaaaaatagttaaggagttatttattcatctttagctattaacttaccagcatctggcccagattttaagttatagatttcagttatttttatgacaacagctccttttggtttcaaatctggttttaatgctttatcaacctcttcagctatttttaaatattcaccttctttgtagtattcagcagttcctttatattggtaaggcatgtctttacaatttgcggtagttaaagcaacttttggattttctaagatattttttagggttttgttcatgaagttatctgctattaaaacaatccctttctcagcatctaagactttaattgccctcattgccgctacatttggaactccatcctttgaagctgttgctataaatacaatctcattttctaaggatttaaccatctcctctgttagctttaccacactatcaccaaaataaattttatgaaacattttcatttaaatttataatgttgtcctatacataattaactattttttattggtgatgattatgagaatttgtatccaaccagttggagatgttaatgatgagattttaaaatttttaaagaaaaaatttggggaagtttttggaatgtgtgaaatacttcctaaaattgatattccaatttatgcttataattttagtagagggcaatttaattcaaccttaattttaaaatctctaccaacagttgaagatatcgttttaggtgttaccgaggtagatatatacgcagacaatttaaattttgtgtttggagaggcagagttatttggaaaaagagctttgatatcactggcaagattaagacctgaattttatgggttgccaccaaataaagatgtcttaaaaattagggctttaaaagaggcgatacatgaaataggccatgttttgggattaatacattgcgaaaataagagatgtgttatgagtttttcaaattctattatcgatgtggatttaaaggattggagatattgcaaaaaatgcttaaaaaagctacaggatagaggaatttatatttcaatttaattttcttctttttcttcttctaattttaatattgcttcagcaatgtctccattacactcctctaatgcctttcttgcttcttcctttgaaacgttgcactgcttagctaccaactcaacatcctcttctgttatctcaaccttaacttcttcttcctcttctactttttcttttttaatcttctttggttttcctgttattgagtaggttttaactcctaatatgtccataacttgaacttttggttcttcaaatacccattcctcatcatcaaatacaaatattacctttctgacatctaaatcttcagtttccataccaaaatctttcatcatcttctgcattttctttaacatccttggatttacttttcctggaaacatcctttcaccaaagttttatatttgatttctatttttattatctcttgatatttttatagtcaatcatcaaaaattttggaagtcattgggtatttataaaacccttggggttttatatttatgtattggttaaaaatattttgcttttgatgagtgactatagttttatggctccaacaataaatgccaaaagaacaatgttcattatgatttttaagaattttgaaacctttgaagcagtttctttatttggctcttttaacaataaagccatagcatagataaacaaaatatcacatattgctatcaaaattagataccatatcccaaatatttttaaaatgtatggaagagggcttaatataaccgctaaaacaaccaaaaatgtagcaaaatataaagattttttaccatactttattggtagtgaaataacgccttcttttttatccccttccatgtcctcaaagtccttaacaatctccctaccccaaattgaaagcaaagagcataaaaacaaaataactactggcataacgttttttccagcaactccaccaaatagaaatacagaaccagttaaataaccaataataaaattcccaattggtttatattttttgtatttttttgcatatagatagaggaaaagtgcattaattacagcaataatcaatgcatatatatttatgaataatgagagaactaatcccaaaattaatagaatggctgaaaatttttttgcctcatttaatttaatttttcctgatggtaaaggacgggatggcttgtttattctatctatctcaatatcaaaaatatcatttattacatttccataagcacaaacaaaaaatacaacaaaaaatactaaaagagattttaaaatatcaatctcaaagtttgatgatattaaataacctataatcccaccaatagatgcagttatgcagtttttgactctaataagctccaaatacgtttttaacttctccataaaaacccccaaatatgacgcttttgtccataaaaaataataacaaaaaactatttatatacccttcacaaaaagtatttggaaaggttaggagttgattaacttgattaaaaaaggtgactatgtcaaagtagattatatattagaagtagatggaaaagttattgacacatcaattgaagaagtagctaaagaaaataaaatatactatcctgaaagagaatatgagccaattggatttattgtaggtaatggagaattaatcgaaggttttgaagaggctgttataggcatggaagttggagaagaaaaaactgtaacaattcctcctgaaaaaggttatggacttagagatgagagattaatccaagaaatacctaaggaaatgtttgctgatgctgactttgaaccacaggagggaatgttaatcttagccagtggaattcctgcaaagataataaaagttactgatgatactgtaactttagactttaaccacgagcttgctggaaaagaattaaaattcacaataaaagtaagagatgtccagccagctgagtcagaataatttctttctttaattctattttttatttttagtctttaagattagtaattaaatattaaataccaacacttttttatatcaaactttttaaagttcttcaaatgctaaatccttagtataaaaatttttatatatgatttcaattttatcattactttacccttaacattttttggtgattggatgaaaggtgctgaagcaatcataaaagcattggaagcggagggagttaagattatatttggttatccaggaggagctatgcttcctttttatgatgcgttgtatgatagcgatttagttcatatattaacaaggcatgaacaggcagcagcacatgcagcagatggatttgcgagagcaagtggagaggctggggtttgcgtctctacctctggccctggagctacaaacttagttactgggatagcaaccgcttatgcagattcttctccagttattgctttaacagggcaagtcccaacaaaacttattggaaacgatgcatttcaggagattgacgctcttggattattcatgccaataacaaaacacaatttccaaataaaaaaaccagaagagattccagagacgtttagagccgcttttgaaattgccacaactggaagaccaggaccggttcatatagacctcccaaaggatgtgcaagatggagaaatagatattgaaaaatacccaattcctgcaaaggttgatttgccaggttataaaccaaaaactgtagggcatcctctacagataaagaaagctgctaaattgatagctgaatctgagagacctgtaatcttagctggtggaggagttataattagtggagcttcagaagagttattgagattagctgagtttgttaaaattccagtatgcacaaccttaatgggtaagggttgtttcccagaagaccatcctttagctttaggaatggttggaatgcatggaactaaagctgcaaattacgcagttacggagtgtgatgttctcatagctattggatgtagattttcagatagggttactggggatatcagatactttgctccagaggcaaagattattcatatagatatagacccagctgagataggaaaaaatgttagagctgatattccaatagttggagatgcaaaaaatgttttgagagatttgttagctgcattaatagcattagaaattaaagacaaagaaacatggcttgaaagaatttatgaattaaaaaaattatctatcccaatgatggactttgatgataagccaataaagccacaaaggtttgttaaggatttaatggaagttttgaatgagattgactcaaaattaaaaaacacaattataacaacagatgttggacaaaatcagatgtggatggcacacttctttaaaacaaagatgccaagaagctttttagcttctggtggtttaggaactatgggttttggtttccctgctgcaattggggcaaaggtagctaaaccttatgctaatgttatctctattactggagatggaggatttttgatgaactctcaggagttggcaacaattagcgaatatgatattcctgttgttatctgtatttttgacaacagaactttgggaatggtctatcaatggcaaaacctatactatgggcagaggcagagtgaagttcatttgggagagagtcctgactttgttaaattagctgaaagttatggagttaaagctgatagaataataagcccagatgaaattaaagagaagttgaaagaagcaatattaagtaatgagccatacctcttagatattgttatagaccctgctgaagctctgccaatggttcctccaggtgggagattaaccaatattgtccagccaattagggtagaaccaaaaataaaaaaaccacagttcgatgaaattaagaaaataagagatatggcagcagttaaagagttttagataaattagcccatgcttctatttttttaaattgttattttcttctctattatattatagtcgttaaatattaacacaaggttatattatataaaagtagcttagaaggagggggtttaatgaaagttgagtttatgcagggaaatcaggcatgtgcaaagggagctataaaagctggatgtaggtttttcgctggctatccaataactccatccacagagatagccgaggcaatggcgagagaattaccaaaggttggaggatattatatacaaatggaagatgagattggaagtatagcagcagttattggagcaagttggggaggattaaaggcaatgacagctacttcaggccctggatttagtttaatgcaggagaatataggatttgcatacatgacagaaactccctgtgtagttgtggatattcaaagaggcggcccttccacaggacagccaaccatggcttcccagggagatatgatgcagtgtagatggggaagccatggagattatgaagttattgccttagctccaagctctgtccaagagatgtatgatttcacaataatggcttttaactatgctgaaaaatacagaattcctgtttttgtaatggctgatgagatagttgggcatatgagagaaaaagtaattttgcatgataatattgagataattaatagaaaaaagccagaagaaaagccatgtaaaaagccatatccttttgataaattaatcccagagatgccagtatttggagagggctataatgtgcatataactggtttaactcatgatgagagaggctacccagatgtttcaccagaaactcatgataagttagttaggagaatagtgaataaaataagaaaaaataaagatgagataattaaatgggaaggagagaacttagatgcagaaatagtatttgtttgttatggttctccttcaagaactgtaaaacatgctgttagaaatttgagagaaaaaggtttggatgttggatatataaggttgataactgtttatccattcccagatgatttattaaaaaagttgaaggctaagaaagttgtagttccagagatgaatttaggacagatatattatgaggttgagagagtttgcaaaaaagcagaagaggttattttagtggataaaattggaggagagttacatagaccagaagagttggagagggctgttttaggataacactcgatagaaatattttaatatggaataactcatagatatactaatatttttttctttttgtgtggtatcatgagggtttatagagtttataatgcttataagattgttggggcagtaatattttctatgagcattattgttattttatatatttcaattattcttcatagtcttaagctttctttttctattatattagctgttgatatattaattattgcactttttgcctatatctttttaaaacccaagaaattagttgttttagataatgggataaaagtagataatgagttttatagttgggatgaggtaatagagttttttgtatctttaaattcaatacaaataaatcttaaaggtaaaagggaagagacatttaattgggaaacccccgggctttttaaatatagaccccaaattgaatatgtggttaaaaaagatgctgaacttttaaaaattttaagggagaaaattgaaaataaagaaagaaaaaggggttgagtatgaaaaaagtatcaataattgttttatttatattatctttaattttaactatttcaatttgtggatgttttgagaatgaaaaagaggaagtaaataaaccaaatatgacagtcattgaaaaagaaaatataaaagtccaaaacaataaaccaatagaaaatttaaaagaagaatcctgtaagttaaatattacaaatgatgaaaatagaacaaataatataacaaaaactacaaaaaaatacgatttttcaaagccagttgatatggacaagatgtttttaaatcttccttataatgaagagacggactttgatgataaaataataaaaaaatataaaaacataacctttgtagtcagcagaaagccaattgacctttcctatgcatacatatataatgaagttaaagagtatcctgaaagggatatttttggcaactacatatattacgagttcattccaaaaaatgccaatttatcaattagttactgctattatagaaaagttggtaattactatataattatgcaaacttatgagaaaagtagaaaagctaatgatttgtggatgaattggacaaaatatgtatttagtttatttgaggaataaattttcattttatttttaattttaattttctaatttttgttcaatttaaactataaatcgcctcagtgctcatacggttcatcacagactcagcaaagccaatcgtcatcattggcgattttttggtgattattatgatgatagggagagctttaatattagatggttatactgacgaacccgctggtttgggggtgcccccttatataggcatttacccaagatatgcttatggtgccttagataaatataacgttaaagtggattatataactatcgataaatttagagaaattagaggagattttaatttaaataaatacgatgcaataatttgtatttgtggatttcacacacctggaaaatatttaaatgcaaatcctgcaacattaaaggagtttgtttctatattatataaatatgatggcttaaaaattttgggggggccagcagcgacaaaatatggctcttcaatgattggaggaaagatagaagatgagagtaaatataaagcattttttgatgttgttgctgagggtgatttagaggcagttttaaatgatttgttgagagagggaagcatagaaaagattgattttaacagatatagaacctatgaagagttgagagaatatgcaataagaggagctaaggttgttaaaaagcatccaaactatccatatataattgctgagattgaaacttatagaggatgcccaagagctttaactggaggctgctctttttgcacagagccaaggaggtttggattgccaaaatttagagatgaaaaagatatcatagacgaaattaaggtattatataatgagggaataaaatatttcagaattggaagacagccatgtatgttttcatataaatcaattgattccgagaaggaagaggttccaaaaccaaatgttgaagcaattgaaaagctgtttaaaggcattaggaacgtttcaaatccaaaggttttgcatatagataatgcaaatcctgcagtgatagcaaggcatgaagatgaaagtagagaggtagctaaaatattagttaaatactgcacttctggaaatgttgctgcttttggtgttgagagttttgatgagaaagtaattaaagccaacaacttattaacaacaccagaagatgttttaaaggctgtagaaattttaaatgaagttggaggaaaaaggggagaaactgggctgccgtatttattgccaggcataaatttattgtttggattaaaaggggagagaaaagaaacatttactataaattttgaatatttaaaagaaatctatgataggggctttatgattagaaggattaacataaggcaagttgttccattttttgggactgatataactctaaaagacataaaaaaggcagagaagagaaaaaagttatttttatggtttaaagaaaaagttagggaagaaatagataataaaatgcttaaaagggttgttccaaaagggacaatattaagagatgtatttgttgaagttaaagaaagggaagatttatactttggaagacagtttggaagttatccattattagttggaattttagataaaaatcttaaaattggagagtttgtagatgttgaggttgttgattatgggaggaggtcgattactgggaaggttgttagagatattagaaaaatacatatagtaggttgagtataaaataagagcaaagagtaagcgtttgaattgatagtcaattaaaataaaggtaggaactagtaaaaaattaaaaaagagtaattatagggatgtttatgaaaatgttgaaattatttcttttgatttgttccgtagttggagtaattctttgttgtggctgtattgctggagacgagtgcagtcctcaccacccaatagacacgctaaatttgctgaggagttaaacacattttctttagaggacgttctaaaaatcatagaagataattttaaaataagctttaaagagagaatactatgatataacaaaatttagtgtaatcttattttttatttttatttatgaaaatcaattaatgtaaattaataaataattaaaataaaaaatttaaaatcatttagcaagggtaaatctcacatcatcatctccaacatcaaaaattcccaatctaacacctgcatcaatccagccataggcataatttagagaggcaaaggcagtcacataatctcctctctctttaaatgccttggcatcttcaaaatagctctctatcatcaataaaaagtccttagcaacatcatacaacaaacttctctttggtggcatgccttttttaataatttttatagcttcctctgtcctcttaaaataattttctaatttttcttcagttatttccttaatcacatttctcaccatcaaaaaattttcttaaacaaataaggtttgtaaattcccagccctttgatttacaaaactctaatgcctttgtgttgtctttatctgccaataatgataatcttaataacccattttctttacagtatctctcagcctccaatagaagtttgctcccaatacctctacctctaaaatgttcatcaacaattaaatcctctaagagtccaactcccttccttcagcagttgatattaaggtttgaatagaacacatccctataactcttcctttatatcttgcaacaaagattactgcatcctctttatttaataaaagttctaatcccttttttgcttttcatagtttggagtaaaatccttctctatctcaaaaagttgttttaatagattaatcatatcatcgatatcttccttttttgtaatatctatagttatcataatctcaccaataattattcatcatcttcataaataaatatatcctcaatcttaacaccaaaaaacttggctattttaaatgccaattttaaagaagggtcgtatttacccttctctatggcgatgattgtttgcctactaactcctaacttttttgctaaatcctcctgagttaaattatgcaatgctctatagtatttcagcttgtttttcattgtttcactatgaaaactttttaaatgtatagaactcaattataaacatatttgccgtaataacaagcattattgttctaataatatcaactgcgttaatacagaactcttttgaaggtaatatcaataaaaacacataaatagtaagtaacattccgaaaattgatattaaagttaaaaatccagatttttgtttaagatgctcaacgaattcatcaaaaacttcaaagattaacttatactttggaaataaaatccccataacaattaaaataagtattgcaaatattcctaaagtaatatctaaaaatacctcattgtagataattcctaaaaatatcaaaatcccttcaataaatccaacactcattgctaataaattctcatataacctttcatttatattatttttatcaataaataaccaaattacaaacactgccaataagaaagctaaaaccattttaaaatttttgataaatagagataaaattaaaactgctaataaatcagtagccaatataagttttatattactttttaagtccatagtttcaccttaagtgtattttaaagcagtagataaaagataatatcaaattcaaaacaaaagttgccattaaaaatataactatatctaaagaaaatgcaacttttacattaaagaaagccataaaattaagaatcagaactaaataaatccaaaaagaaaggattaacataatggatgattttttaaatatctctgcttttaattcatctattattaaaaactctgttaaaaatccgagaagtaatttacccatctttttcctctatcatgttaataatactttacattatgttaagtatgtttaacatttttgtatataaaatttttcataaaaatatttaaatacttagaattataaataattggaaataaaataggactttcgcatgaggaaatattttattatataataacactctttgagtatttaaattccaaattcaatatataaactgtggaaaatcctataaaaccactatgaaaaataaacgtgagaaaatgagaccaaaatcatcaacgattttaatcctcttaatgtcagttttgattttactactgtctattgatattttagcaaatcacataataatcaaagtagatggatattactatgatggtttagggcagaaattagcaatgaaagatgtaattcccataaatgcctcttttaataaaataaaatctcagttggagaaatctatgaaattccattaaatgaaagctgggagattaagatttatgacagtaattcaacaataaagctgtttaaaaatcaaatcggctattatattgaaggagttaaaaaaggaactgctatagtgtcattctcaaaaataaatacaacatcatttttagagaaagactatgtaatccatgtaaattaattttattttttcttatgcctaaactattttcgttaattgcttaaatctccaaaactttatatattacttttaataattgttaatgattgataatgacagtttaaggtgagtgtatgatagaaattagatttcacggaagaggaggacaaggagctgttacagcagcacaaattttagctaaagctgctttttatgatggaaagttttgtcaagcatttccattctttggtgttgagagaagaggggctccagttatggcattcacaagaatagacgataagaagataacattaagatgccaaatctatgagccagattatgttattgttcaggatgctactcttttagagagtgttaatgttgttgaggggttaaagaaagatggcgctgttgtaattaacactgttaaggatgatttagatttaggctacaaaacatatacaattgatgctacaggaatagcgttagatgttttaggagttccaattgtaaatactgcaatggttggagcttttgctggagttacaggaattgttagcatagaatcagttaaaaaagctattttagatacatttaaaggtaaattaggagagaaaaacgctaaagctgctgaagtagcatacaatgagatgttaaaaaaatatggataaattattgaggtgaattaaatggttacaattgcagctattatatatgagccaggaaactcaattaaaaacaaaacagggacttggagaacatttagaccaattttagacaatgaaaaatgtgtaaaatgtgaaaattgctatatattctgtccagagggggctattcaagaagatgaaaatggaaacttcaaaatagattatgattactgtaaaggttgcctaatatgtatgaacgaatgtccagtaaatgcaataacaaaggttagagaagagaaataaaataaacactaaattactaaggtggaaactatgtgtgaagtcaaggttattacaggaacttcagctgctgctgaagcggctaaattagctgatgttgatgttatagctgcctatccaattacaccacaaacaacgtgtgttgagaagttagctgagtttgtagctaatggagagttagatgctgaatatataaaggttgagagtgagcactcagcaatgtctgcttgcataggggcagctgcaacaggagcaaggacatttactgcaactgcttcacaaggtttagctttgatgcatgaaatgttattcattgcatcaggtatgagattgccaatagttatgatggttgctaacagagctttatcagctcctataaacatctggaatgaccaccaagattcaatagcagagagagacagtggatggattcagatatatgttgaagataaccaagaaacacttgacagcattattcaagcttataagatagctgaaaatgaagacgtcttattgccagtcatggtttgtttagatggatttatcttaactcacacagtagagccagtaacaattccaaaggcagagagagttagagaatttttaggagtttatgaaccaaaacacgcatatttagacccagacagaccaataactcaagggccagtaggagttccagattgctacatggagacaaggaaacagatagaggaggctatggagagggctaagaaagttattagggatgttaatgaggaatttgctgaatggtttaagagaaagtatggaaatggtttagtcgaggcttataacttagataacgcagataccgttttagttgcaatgggttctgtttgtgggacaataaagtatgttattgatgaacttaaaaaagaaggcaaaaatgttggattgttaagaataagagcctttagaccattcccaaaagaggatgttaaggagcttttaaaagatgccaataatatagctgtgttagataaaaacatctcattaggatttaataaaggagctttaggtattgaaatggcatcaattttaaagaataagaaagtttgcaactacattgttggtttagggggaagagacatcaaaatagatgatataaagacaataattaaccatgttgaaaaggcagaggatgactctacattatgggttggattaaaggaataaataattttatttaaataattttttaaggtgattgtaatgcaatttccaagagaagaatattttgcaccaggacacagaggatgtgctggctgtggagctgctattgtagcaagattactgctaaaggtagctggaaaagatacaattataacaaacgccactggctgtttagaggttatgactaccccatacccagaaacatcttggagagttccttggattcatacagcatttgaaaacgctgcagcaactgcaagcggtattgaagcagctgtaaaggcattgaagagaaaaagaggaaagtttgctgataaaaaaataaatgtcattgccattggaggagatggaggaacagcagatattggttttcaggcattgagtggagctatggagagggggcacgatatattatatattatgtatgataatgaagcatatatgaacactggaatacagagaagttcatcaacgcccttcatggccgctacaacaacatctccagctggttcaaagattagaggagaggataggcctaaaaaagacatgacaatgataatggcagctcatggtattccttacgttgctaccgcatgcatttcatatccagaggactttatgagaaaggttaaaaaagctttaagcattgaagggccaaagtttatacaagttttacaaccttgtacaacaggttggggatatccaccagaaaaaacaatagaaatcggaagattggctgttgaaactggaatcttcccactttatgaaattgaaaatggggagtttagaattacatacaaaccagctaagagaaagccagttagggaatatctaaagatgcagaagagatataggcatttaactgatgaggatattgagagaattcaaaaatatattgatgagaaatgtaagttgttaggattgtaattaaaatttctttttttactaaaattaaaatagtttttggtgatggtgatgaaaaaaataatcatgacaaacttcaactgtgataactgtggggattgtgttaaggcatgcatggagaagaataaagttggaagaattgccataatggagaaagatggcaaatacattccaattgtctgccaacactgtgcttcagctccttgtaaggaagtctgcccagtttcagcaattgaacataaagacggctacgtctatttaaatgaagatgtttgtattggttgtggtttatgtgctttagcatgtccatttggagctatattgatggaggataaagcatacaagtgtattttatgcaatggagatgaaccagcatgtgttaaagcttgctcaaagagatgcttagagcttgttgatgtaaatgagttaatatttgctaagagggataagtctttagatttatttagtaagatgtctcttcctacacaaaaatcagataacagtttaatttcaaaaataacaatagacgcaaaagttaaaccttaaattgttgtaatattataactttttatcttttttaatcccttatgcaccaagtgaagagttttcttttattggctattgatggtgaaaaaatggttgtagtaaatgttgggtcttgcattggatgtaggagatgtgaaaggagttgtccaataaatggaataaccttcaatgaatttccaataaaatgtatgcattgtgatagaaatccttgtctatatgcatgtccggagaatgcaatagagaggattaataacaaagtggtggttataaaagataagtgtgttggttgtggtttgtgtgctttagcatgtccatttggagctataagaattgatggagtagcgataaaatgtaatggatgttataaaagagatgttgagatttgcaaagaagtatgtccaacaggagctattaacaaccttgaagaaatattaaataataaaatacaaaatacagtgaataaatttaataagctttactatctttatgcaaatgcaaaataattccttaattttcctattttcgtaattttataaggttcgaaaatttacaataaaacatataaacctatttttattaattgtccttttatcgaatcttcaatggaatcttcacaagagtaaattttatatttttatatagataatatcttcaatgttaaatgttatagttatatacaaataatataacacaacattataacacaacattcaaattaacagatttattagagtggtataaatggattatgataatatggtaaaaacattagaaatattaaaagatgttgttaatgccttagaatgtgcagataaaggaaattttgataaagcattagaatatttagaaaaagctcagaaagttgataaggataatcctttagtattgtatgtaaaaggaattgtgttaaaactcaaaggagatatggaaaaagcagaaaaatattttgaatgcttagaaaatattgaaggaacatctttattgtctttagggaatcttatatgtttaacattcgttaaaggagagtatgaaagaacattaaaatatattgagaagttatcaagattatctaaaccatgctatttgtctccattccataaagctttaatttatatagaatttggagaatttgaaaaggcacttgaagctcttgatgaatttttaaaaatatatccaaatctaacctcaattttaagacagaaggcatcaatattagaaatacttgggaaattagatgaagcactggattgtgtgaataaaattttaagtattaaaaaagatgatgcccatgcatggtatttaaaaggaagaattttaaagaaacttggaaatataaaagaagcgttagatgcattaaaaatggcaataaacttaaacgaaaatctagttcatgtttataaagatatcgcttatttagaattggcaaataataattatgaagaggcattaaactatataaccaaatatttagaaaaatttccaaatgatgttgaagcaaagttctatttagctttgatatatgaaaatctcaacaaagttgatgatgctttaaaaatatatgataaaattatttcaaacaaaaatgttaaagataagctattaataaaatcatctatactaaataaagcgagaatcctcgaaaaacttggaaaaattgaagaagcagtagaaacctataataaagcctttgataacaacatttaaaaaaataaaaatttatcttccccagaatatgttgtttgttagcttttgcatcaactccatatatcttaacaatgcctctttttcatcatttctcaacctatccatgtatttatggtagagctctctaacatgactttctggaacagctacatacatatagtccccttcatcaacatgcctttttaatacaactcttccatctatagctattgaaactgcctttcctgcttttgcctctttaacattttctcctctatcttttatttccctaacataacctaattgcattccatcctccctcattaaaggagctccaactcttaaagttccacagaggacttcaactccacaaattgcagggtctttctgtctgaatatacaatctggtaaaatcctgatgattgctggcttgataagtttttcaaactctccatatttaattctctcttcctcttttttaatccactctgtgaagtcctcaaccaacttatagataatgttatctaaaaacacctttatgtcatatttttcaatttctttctgagcttctggtaaaatttttacgttaaaggcaactattgctccatgtaatggattactctgcttgtatgatgcaacttcaataacatccttcttagttacatctccaacctctgccttcttaatcttaactcctgccttccttaactcattagctaaagcttctaaagaaccaagagtatctgcttttattaaaattccttcatcatcaacctctatctttgcctcttcaacttctttcataacctcttcttttgcttcctctatcttatcttttggaacaatccttattggacatccagctatgactttatccaattcaggagcggctatcttaactcctgcagcggcagtaacttcatttactggcttaaatttatctcttgggtctctcatctcatctaatggcttcggctttaataaagctttaactcttgtcactaaaacatcatcaggcaatccaacaactaaataatctcctctcttagcaatcccatcataaattatggcatctatcgttgtccccaatcctttttcttccttaacttctaatattgttccctttgcataaccttcaacattaagctttaatctatcctctaaaaacttttgggctaatccagcaaccatcatcaataaatcaggaattccctctccagtaactgctgatactggaataatacagacagtttttgtaacgtcttgaactcttgagtataaatcagcatcaaaaccaagctcatttaatggttttattatgttttcatacaaccttatttcaaattcagttaaagcatttggatgctgatttttttcattgaagtttaagataaacggcccttccttagagttccatccaggaattaagtcaattttatttgctgctacaacaaatggggttttgcactgtcttaatatattaacagcctcaacagtttgtggtttaaagccctcgtttatatctacaactaatatggctatatcagccaaagctcctcctctttttcttaatgaggtaaatgcctcatgcccaggggtgtctataaccaacaatccagggatttttaaatctgcttttagcatctttaataaatctccacacagccgttttatgacatctattggaatctcacttgctcctatgtgttgggtaattcctccagcttctcttttagcgactcttgtttttctaatcttgtctaaaagtgttgtgttatgaacaactataccatttgctataaagttgtgtgtttcagttgttaaatcatacacatagccatcataatcaataatttcaacatcttcaacttcaacaaatgcaatattttctattaatgatttcatatagtcaatattctcttttccaaattcatgattcttccaaatatttaatgcttctcttcctaatttagttaatcttccattctctattaaaccatcgctttcaaatgcttttaaataattaacatctctttcttttccttccaatacttttatctttttatctaagttctttggttttaatgaatttaggaatttcttaacaatttcataggaaggaatctcttttccattttcatattttgcatagtatgagacatttacttcattccttgtcattccaaacaaaattcttaatcttttcatatctttatttattggatacttctcactttttctactcttttcaatgattttgtttaagttttcttctttatattttattgaaaacccaatgtttttgaagttctttaagtttctctttcctacaatgtttaattggtagtatttctttttagtttctttgtaagattttttaatttcatagatttttgatgttatttcgaatcttaataaaagaatagaaagtccttcaataaattcctttgatgcacttattacttcaattctattctgtcttaaatttacatacccatctgcatcaaagtatcctttaataaactctgctacaagctcttttggagctatgtataatatttgtgggatttttatattatgggatttcttttcacttgggtaatcaaataatattttaaggagattaattaacgcattttttccatttttaaatattatttcataggaactttttctttttattctctcaacttcaattcctaaattattcaatgattttaatttgttgaatacttcttcatcattatttgctattctatccacacatccatccccaaacataactcctgcaaagtagaatatagctttccattcattcaacgactttggaagttttatatagtgctgaggttttccacatctgtggattcttggagagaatgatattttttcaatatttagattatgttcaataatatcttcgcttctgaaaacatttttctgttttttgtagatttttgttgaaggcaactctacgttttttaaatctttctcattaacttttacaattaattcattagttaatatctttgaattaataaattcaatgaacttctcaaaatcctcattaccataaatttttcttggtattgcaacatacattccttttttgatattttctgcttttatccaaccattattggttaagaatggatgttctggcgttgtagttattgaatgccaattctttaacttaacttttatcatttttcctttatgttttagtttccacacataaggagcatttattatcttaatttctccattttcatttagtgtatgaacttttatattcaactttcttatttcttttaactcatctttctcaacaatctcttttcctattttaaataagtcctcaatcttaatctctccatactcagttaaaactttctcatgaggcattaagcactttccatggtcaacgtgtcctaaaacacacacaattggacatctgagattctgatttttattatccttcttagtgttttttttagccataataatccctcttaatgtgttttaatcacaatatatcaataaatttataaattcaagttatcattatatattattatttgtgaaattactacttcctttgatgtttaacttatatatattttatttgcaaattatttagcgaatagaattcttataatatagtgatagttatggactttaaaaataagaaatgtgaaatctgtggtaaaaaggcagagatttttttatttgggaggtttttatgtaaaaatgaaaagtgtattgaagaggctaaaaagctgagcatggcgagacataagttgaggattgtggcagttggttctacaaatccagtaaagatagaggcggttaaagaagggtttgagaaggttttaggagctgttgaagtaataggggttgatgttattagtggggtttcatctcatccaattggattagaagaaacttatttgggagctttaaatagagcaaaaaatgcgtttgaaaaagttcaatgcacttatgctgtgggaatagaggcaggtttaataaaagttggagaacattatatagatattcatatatgtgttgtttttgatggagttaatgagacggttggtttatctcaaggttttgaatatccaaagattgtagctgaaaaagttttggaagggattgaaggtggaaaaattgccgaagaaatttctggtattaaagacattggaaaaaacattggcttaattggttatctaactgataataatataacaagaaaagatttatgcagggagagtgttataatggctttaattccaagaatgataaaaaatgctcatctatattaaatagttcttttcaaaacattatggaataaatatatgaggtggaatcattaacctaaaaatcagtaaaaaagatgttgttgagtggataatattcttggttgttttgtttttaatttggagtcatgtaaatgttgtcgtttctgatagtatgtatcctataatgaagaggggagatttggttatagtggaaaatgctggctttgaatttaatccaaacgatgttgatgttggagatatagttgtttataaagctcattggccttactatcaatatttactttctgaaatagattataaactcaacttaaatccttacactacactatatatattcaaagagggagattttaaagatatgtcagtaaaagttttaggagaaataaaaacagacaaaagcagttacaaaatattggaggctgatattccaaaaagtccaacaaagccagtaatccatagagttattgataaagttgagtttaataacaaaacatactttataattaaaggagataacaatccaatccatgacccagagcttgtttcaatcaaccaaataaagcagagggttatagttgtagatggacatcctttagtaatcccctatgtaggttatttatctatatggcttaaagaatattggtatttggtggttttatttgtcctgatttattatgcatacaattatcttaaaggagggagaaaatgaaaaaactactgttaattattggaataatctcgttaatgacttcaatgtctatgtgtttaaataataacaatttaaataatttggatttaaaaaagagcatattagttgaagttaatggaactccaatagaaattccattgagagcaactgttggtgaagcaaaggaggtaaaattgataaatacaacagatagggaaatttataattattatcactcaaagatattgatttatattaagggagatatgaacattagtgttaaagaaggaggggtttcaatagttgatttagtaacaaaattagagtggtttaatcagttttacccccacaatatagttgttgagctaaatagaactaactcaacagtaactgtaaaatccatttttgcaaatggaaaaacatcaataactgagcttaaagtaaatgaaagtgaatatttaatgcacaataacaagacgatggttatagaaatcttaaaaacccataatactgcaacgataacaaaaataaataacacatttataattgaaggaaattcattaaaagaattggataatgcagaaacacggtttgttattgacatgtttaaagggagtataacataactgattggatattatttaatttaataaaattttaattttaataaaaatctcttttttgtggtgttttttatgttgattattgatgttaatcatggagctttaacattggctgaggaatatttaaatttaggatatgaagttgatgtatgggatatttaccaaaaaataaaaaaatcagaagattttaaagttaaatatcaaaaattaaaagaaaaatttggaaataagttaaatctattttttgaacagccaaattttgaaaaatatgatagagttatagccccaatacactgcccaatagatgttgattttatcccatttacagatgctgtatctaaaatattaaaggagaagtttggaaatatccataaaaaaataattaatgttacaggagttaagggaaagacaacaacaacctctttaataaaccatattttgaaagataaatattcaacttacttacacaactcaaattttggctctatagctccaccaactattttaaaggttttaaatagtttagatattgacaaatatgacttttttatatttgaaacatctttaggattaattaaatgcaaatatggagctataacaaatgtattagaaaattataaaatagctggtgggagaaaggatgcattaactgcaaagtttagttctttaaaaaatgctgagttatcttttataaataagagagatattaatagatatgacttaaatataaaccataaatgcctaaatgttgttgatgtagatagggcaaagattttagataagtatcctctaaaatttaaatactttgatgaaatatttgagttcagcaagaacatctttggattacattttgtagaaaattcgttatttgctatagagatttgtaaaaatttggttgatatggaggagataagatatagattaaaaaccttcaccataaaaaatagaatggaaattaaagagataaataaaaaaattttagttaaaaatatcaaccctggcttagatgtaaaagctatttcctacgctataaaagattttttagaagtatttggtggagatatctatattggcggggactttggaattgtttgcgaagaaattgatgtaaaaaagctatctgaagttttaaagagatttaactgccgatatatatttgttggggaaattggaaaagagttgctaaattatttaaatggggggtatattaagagttatgatgaaaataagataaagagagactctttagttattcttagagaaaaaataaaataaccactatagaataattattcaaaaatctttggatttatctttctattttcattttacaaccatagggcttcgccctattgggataccccatttacacctctgcctttggcagagatgttagctttgatgaaactttattaaagtttcgggttgattttcctattttcattttgcaataacgccactctactatcttcactgtcatcaattaatttgtatgagctgttttcatctaacatcttagctaattttaatatctcatcatgttgtagcatgtcctctttctttaatcttttttgagaataaccaacgtgcatatatgactttaactcaatgaaatggacatcagctctttcatagagctctacaaactttaagatatcatcattatagcccctaattaaagtagttcttatacaagttctcttcttctcttttaaaatgtctaaggtatttaagatactttcccaatactctttcttccccccacatattcttctataactgtccaaatcataggcatctaatgagatatacagttgagttggctctattttttcaataacatcagttaagattccatttgaaacaacaaatgttgtaaatccattcttatggaatatctttattaactcatctaagtatggataaagtgttggctctcctgataaagatattgccacatgctttggctctaaagcctctttaaatttcttctctccaactctatctaacactccagcataacccataattattcttttatgcatggctaaaattttctcatatacaacctctggctcttcccattttggttctttaatttggcttatatctatacctatatcccttggtaaaactctccagcagaatatacaattttgctgacaccaaataactgatggtgtgcattgaatacatctgtgtgtttcaataccatagaattttgatttatagcaatttttatcctctaacatcttttttctaacccatccacacaacttaacggctgtgtggccgtctatttgatacctctgctttcttaaaattttataaatttcttctggaatcatactctcactttaaatatttatttattttaatgaatgatatttttggctcctttttatcgcttccataaatctatatctccatagggggaaaccccctattgggataccccacgtccattaagttggggctttcagccccaattaatgtccaatctatgtttaactcctttttatcgcttccataaatcgatacttcaaaacaacaggtggaatctctatattagaacatttttcattgtatggaattgtcttagcaataataactttacatttttcttcatttaaagcatttttaaactctttttcaaattcttctaaactttctgtagttattgtatctaaaccacaacccttagcaatttcttctaagtttgtatttttgccagtgtgtgttttttgattacctgtagaaccataagcagaattatctattataaccaatatataattttttggattcatgtatcctattgttgatagtgagccaaggttcatcaatatagaaccatccccatctataactataaccttatcttcacaatttaaagctaatcccaagccaatagaagaagctaatcccattgaaccgagcatataaaagtttctctccctatcttttacataatacagctctttagaaggaattccaatattgctgactattatctctttctctccgacattttcaacaatctttttaattatatctattctctttggatacatggtatcatctcttttacttttctaaatcgtattcccaatatagagcatcaaacagtaaagctacaggatatgagattttatacatataggaggaagcatattttattaatttatatgcctcttctggtgtttttggtttataagtagggatttcacaaacatctaacaatttctcaatccatcttcccataggtatttgggcaggtatttgttcctttaagtctcctctatggctgattattaataatgtagggatttggaaggttttgtataatgaggcaatggcatttattgagtttccaatacccgaattctgcattaatatagctgttttcttcccagctaagtatgctccagcacatattccaaatgcttcttcttcccttgttgctggtatatttattatatttttatcctcttcaattaatttcagtaggttttttaagtttgcacatggaacagagcatataaaatctatatttgagtcttttaaggcgttgtatattgctaagctacctctcatcttatccctctttttatcatttggaaataaatcacaaaaaatatatacttaatcccttactatttactatcaaatttttataattttacactgtgtttatattataagataaatatataggtaaataattccttataagaaataaaggtgattagatgaaagcatttgaatttctatatgaagattttcagaggggcttaacagtagtattagacaaaggattacctccaaaatttgtagaggattatctaaaagtttgtggtgattatatagattttgtaaagtttggatggggaacttcagcagttattgatagagatgttgttaaagaaaaaatcaactattataaagactggggtattaaggtttatcctggagggacattatttgaatatgcatacagtaaaggcaaatttgatgaatttttaaatgaatgtgaaaaattaggttttgaagcagttgaaatttcagatggttcttcagacataagcttagaggaaagaaagaatgctataaagagagctaaagataatggatttatggttttaacagaagttggtaaaaagatgccagataaggataaacagctaactatagatgatagaattaagttaataaactttgatttggatgctggagcagattatgttatcattgaaggcagagagagtggtaaaggtatagggctgtttgataaagaaggaaaggtaaaggaaaatgaattagacgtattagctaaaaatgttgatataaataaagttatctttgaagctccccagaagagtcagcaagtggcttttatattaaagtttggtagttcagttaatctggcaaatattgcatttgatgaggttataagcttggaaacattgagaagaggtcttagaggagacacatttggaaaggtttaatcaataatttcaatccctctctcaactattctaaatttaactctttcctctccagcatgtagatgtttctccaatatagccaatctatctccgttgagcttttccaacctaacaatacatttactccaatactctaacaacctccctccagaagcctcaaagccattaacagtctctcttacttgatttgttattataacagctaagttatttgttttagctaattttaataaagtttttacttggttgccgagcattttattgagcatgatgtttttattagcttcatcactcaactctaatctatataaagatgttatgttatcaaccactatcaaacttgcattattggttattaatggaagctctttttgtataattttatcctgctcatagaaatcaaaggcattgtatataatcatattttctaaaactattttgtaattatttgaggctatttgtttaatcctctctattgataaacccccttcagtgtctatataaattaccttcccagaattaacagcgtttatagagttgataatacatatatttgtcttccctacgcctggaggcccataaatttgagttattatccctttttcagcatttcccaataaaatctcttttagcatgtaaatcccttatttcttaatttctcccagaattatttctattgctttatcaactgccttggcaacctcttcagacaaccctggttttatgtctggcattgtaaattctttaccttgacaaccaataaccacgacttctatgcctttattatgtaaatctttgagaaatggggctaatggaacgttatgggcatcgaaagaatattttttaatattcggtaattcatcaacatctatcttttttattgttccaggttctaaatcaaaatcaatggcatcaacaacaataatcttttttatatcttcatcaaccaacgtcattaaatagtatgctccacttgccccagcatctataacttcaacgttatctggcaagttcattttttctaatttgctaacaacctcacatccaaagccatcatctccaaacaacagatttccacaaccaacaattaatatatccttctttttcattttatcacttatttagcatttctttatattttttagcctcttctttaggattttgtgattgatagattgcccttccaacaatgacgtaatcattctcatctaaaatatttaaaatatcctcaatcttccctccctgagctccgactcctggtgttattactggcaattctgcaatttctttaatttctttaagcctttcaggccttgttgatggagcaactatagcatcaacttttagttttttagccatctctgacaatttatctgctattggctgtagaaattgaacagcccctggatggctcatttcagtaaccattattacctttttgtttagctttttagcaacatcttgcactgctttaactgaatcctctccaacaaaaccatgaactattattccatcagcatattttaatgttatttttgctatcttctcatttgttgctgggatgtctgcaaccttaaaatcagctataacctctttattacaaagtttttttatttcttttataatttctgtcccagtagataaaactaaaggatatccaacttttatagcatcaacgtaatctttaacatcttctactatttttaaagctctatctctatccaaaacgtcaagagctaacattaactttggcatcctatccccgcaattttttgcgttatagtttggataaaatttatataaaaaagttgatgtcaaattaactgtaattaatattaagaatattttatatattgtgaatttattggtgagagtatggaaaatttagaaaagaaaatagagcttttaaagaaaataagagagtttcttatcttaaatttagaaattaaaaagttaatgcaggagttaaatgtagatagtgatatttacgaagcttatgaaaaagttacaaaaattgttagagagccaaatattaagctatatagacagtattatgatgcaataaaagagatgttttatgaagaatatggtaaaaaaagaaaagatatctcttggtatcccaaaattgattataatagatgcaaaaattgtgaaaaatgtatctctttttgtccaagaggagtttatgatgcagaaaacggaaaggttgtagttaaatatccatatagttgcatagtaaattgtaatgcttgctctataatgtgctgtgaaaacaacgctataatattcccagatgaaaaaatacctcgtaggaattgaagatggaaatcttaaaaagagaactttgctatttttaaacttttatttttgataatagataatttttaagattagaaaaatctggtgagggaggaggatttctattccgaaacggtctgattttaatacaacattaggagaattacaaggagaatttagaacattgttcccattccgaaacggtctgattttaataatttaaaattagaaaatccaaaaaacagcttaaaaataatctatgcgtttccattccgaaacggtctgattttaataaaaagattgaatacaaaaacagaatatatgaaattgttaatggtatatttccattccgaaacggtctgattttaattaagttataatagctgtttcaattgctttcttttcatcatttccattccgaaacggtctgattttaatcaaatctgtttattagatgtagcgcgtgtgcgaaaattcatttccattccgaaacggtctgattttaatgaacctctatcgccctcgatcaaagaatgaatctcatatttccattccgaaacggtctgattttaatgcaactatgcataaaccacttagcaattccaagaaatttccattccgaaacagtctgattttaatgacacacagagtcagccagacccagcacaaatgatgcaaatgaatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatgaaccctcaagggaacctttttagggttccctaacagatttccattccgaaacggtctgattttaatcaatccttttgagttttggatatatccctcatccaatcatttccattccgaaacggtctgattttaatcggctctcccaagaagaagatgagaattctacaatcacgtttccattccgaaacggtctgattttaactgaaattgttgcagtattacctccaaacttgttagaaatgcttgttgaaaaatttccattccgaaacggtctgattttaataaaattaagatacgatactgtaaagagagataaagaatttccattccgaaacggtctgattttaatatccgagcgttcataaggattttaaacataagaaaatcatttccattccgaaacggtctgattttaataggaaataactgattaataaatctgaatatttaacagtaatttccattccgaaacggtctgattttaattaatttctatttgtataatccaccaaatcatcaaatatttccattccgaaacggtctgattttaatcatatctatacaattacactgattatgttgtttaataatatcatttccattccgaaacggtctgattttaataggacaatcatcaacaacataacatacttttacttttctaatatttaagctttcctataccttatttttctaaggttgggtaactatctcataatataaaccttttagtatttaaatctttctccctttactaaaacaaagcatttttatctttttaaattcaaaaatttaacttatttgttagagaaattttatttattcttctaattaatcctaatttttaaaaatctaaataattcaataaacttaaatattccaaataatcaaaccagcaaacccttagaaataagataaaattatattaaataaccaaataaaaatttcaaattaattattatcaaatataaaacttttccaacgtgataaacaaattattaaaaaatggatggaagatttatcctaaaatctccaatatcttggctttaacttttccttttcctcctcttggctcaactaaaaccttcccacatgttaaacacttaacaacggtagctggacttccaaatacaatctgctcgttattgcattctggacattggactcttaagaactttgtccttggctgtgggattaactccatcatctccctctctacaattttgtttaaagtgtttaaaagagttttataaatttattaaggtttttaaaatttatttctcaacgaactcaaatcttcctgacctgaagcatccatttgcctttgtgtgcatctttccacattcagtacatttaaatcttaagtcaatctttttaactggttttgacctgtctggtaatggtcttgggaaacctccataaccagcagtaactcttctgaactgcctctgaccccaagtcaattcacttggttttcctttttttgccttctctacaatgtggatagtgtgttttttacagtatgggcagtatcttctaactttcttcgggattttcataactttcacctatccttgagataattctgtgtttttctaaaatatgagatatctttctgtctaaagagagaacatcatttttgtttaggtcatatataaaagtaccatctgtgaatggtggaaagtttttatcaacctttacaacatcaatatcgtttattgtatatataggttttggtgtatcaatctcagtaggttttttaaattcaggagtttcctcaattttcaattcaacaacaatattttcaatggcatgtataatatttaactcttctggaagtaagttttctctctcattatccaaatacagagctttgtatattctcaactttctaagctctttgaaataatattttaccctttcaagttcaatatcatctttaatattttttatatattccctaatgtcatcataaaagtcatcaggcaattttaacaatttatcattttttatttcttcaaaaaaataattttttagagattcatacatggttatcacaaaatatggtttgtggtcttttgaaaaacatctgaaataaataataattatgaaaaccctcaaaatatagtaaatgctgcagaatggtttttatccttcaattcttggagccaataggaaggttaaatttacccctgcaattgaatattctaattttagaggcatgtcattacctaagtaaatcttaataatgtctcctgagctaacacccttaaccatgtccattaaataatctaaattgaaagcactttttgcctcttctttaacctctaagctaattatagctgagctatccttttcaaatattgcttcattctcgtttaaatctcccttagcatgaataacaaacttatcctcatcagcttttaaaattacataatcactgaataaatcagcatcctttaaagcctctttaaacgcatctcctttaatcatgattacgtttggatattctatttcaggaactttaactgatgaggcagatatatctaacaaagctaagctgaactttctctttccagtgttttcaaatataacatttaatttattcttttcttcgtctaactctaaaattagcctatctttagctttagctctattcattacttttttaaatgcctctaaatctataccaatatcatgagaatctgcttcatattcttcaaaagccaatcttgggatttccaaactaactaaagcaacatggcttgggtccattgcactcgcttttatcccttcctcatcaacttcaaaacatatctcatctaaaagtgttgagattgtatcaacaacttttttaaactcttttgcactctccataactcctctgaacataatatatcaccaatattttaggtagttgccaaaataaatatacttttctgagggaataaatataaaacctatttgaggttttataaatacctttttatgtcaaacttttgacagcagattatatttataataaaaaagtaaatagtaatttatccattaggattataaaaacatttttatacttcttctatatttttaggtattgtccatcttttgtttttatacataaacaatacaaataatatggcggataactttatatattttatttaagtttttataataacattctggggttacaatgatagagaaacttgctgaaattaggaagaagattgatgagattgacaataagatattaaagctaattgctgaaagaaatagtttagctaaggatgtagctgagataaaaaatcagcttggtattcctattaacgacccagaaagagaaaaatatatatacgatagaataagaaaactttgtaaagaacataacgttgatgaaaatattggcattaaaatatttcaaatacttatagagcataataaagctctccaaaagcaatatcttgaggaaacacaaaataaaaacaaaaaataattaaaaattaatagaaaaataataaaaaaggataagaaggtgagatgatgggaaggattaggcagacattaattaaaagaacagctatggaattaattaaaaagtatagagatttatttacaactgactttgaaacaaataaaagagttttagaggaagttgctcaaatctcaacaaaaagattaagaaatagaattgcaggatatataactcacaaaatgagacagctccaataaaggtgaagctatgtttaagggggtctatcccgccatcattactccttttaaaaataaagaagttgattttgatggattagaggagaacataaactttttaattgaaaatggagttagcggaattgtagctgttggaactactggagaaagccctactctatcccacgaagagcataaaaaagttattgaaaaagtggtagatgttgttaatgggcgagttcaggttattgcaggagctgggtcaaactgcacagaggaggcaatagagctttctgtttttgctgaagatgtgggagcagatgctgtattgtcaataactccctattataataaaccaacacaggaaggtttaagaaagcattttggaaaggttgctgaatctataaatcttccaatagttttatataatgttccatcaagaacagctgttaatttagaaccaaagacagtaaagcttttagctgaagaatacagcaatatttcagcagttaaagaggcaaatccaaatctttcccaagtttctgagctaatacatgatgctaagataacagttctttcagggaatgatgaactaaccctcccaataatcgccttaggaggaaaaggggttattagcgtagtggccaacatcgtcccaaaagagtttgttgaaatggttaattacgcattagaaggagatttcgaaaaagcaagggaaattcattataaattgttcccattaatgaaggcgatgttcattgaaaccaacccaattcctgttaaaactgccttaaatatgatgggaagacctgctggcgagttaagattgccattatgtgagatgagtgaagagcataaaaagattttggaaaatgttttaaaagatcttggtttaatttaacttttatggtgaagtttaatggatgaaaaaaccattgaaaaaataaaaaaagaggctgaagagattattaataaatttagcgaggtattagagaagttcaacttagagatggaagagagttactatattatagacaccagaaatgttttaagagaggacgaagcagttgaaagtaatccagaattcagagagaaattcctaaaaattgcccctaaggtaaataaagagggctatgttgttgtagaaaaaggtagctggttaaaataacaaaaccaaaaagtttaagtaatggtttcatattattgtaggtaaaaatttaaaaaacaagataagagggtgataccataaagaggagttcaagaagatggaaaaagaaaggaagaatgagatggaagtggtacaagaaaagattaagaaggttaaagagagagagaaagagagctaggtcataattttttactttccttattttatttttatagaaaaattaatcaattaatttaaataaattgtgagattatgaaagttgttggcttaaccaaaaaaattatggaacatttaaaagagccaataacaattaaagaacttgctaaaaaactaaacatgcatccaaaaaacttagatgttaaaattagagttttaagagatttgggattagtggaaacaaaaaaaggtagaaatggaggagttagattaacaaaagaagggttatatttgttagaaaaaggagaaattaccttaggatctttaaaattgcagattgttgctaaggataggattggtttgttagctgatataacttcaagaatatcaaagattgggggcaatataacatcaacagtccttgagagagaaggagatgaggtaattatttacttagttgtggaaaatgtagataaggatgagataaaaaatactttggaggatgtggttgaaaaaatctccattctttggtgagttgttatgatagaggttgagattaaggtaaaaattgatgataaaaataaagttgtagagcaattaaaaaaacttggatttaaatttatcaagaagaaatttcaggaggatatttatttcaatggaattgatagggactttagagaaactgatgaagctttgagaattagggatgaggatggaaatttctttgttacctataaaggtccaaaaatagataaaatatcaaaaacaagagaagagattgaagtaaaaatagaggataaagaaaagatgaggcaaatatttaaaaaacttggatttaaagaagttccaccaatcagaaagattagggagatttacaaaaaggaggatatagaggcaagtattgatgatgttgagggtcttggcttattcttagaattagaaaagtcaatatcagatattaatgaaaaagataaggttttagaggagatgatggagatactgaaagctttaaatattagtaaagacaatatcattagaaaatcatacttggagctaaggggattataatgaaaaaaacaaaaataggtaagaggcaaatattggcgatatttgtagctttagttatgatgttatcaataattccagtatttttaatgggtttttagattatttaaaataatttctaatttttccaactaactcccttaaatcgtttatgttagaagctcttatgtcctttttttgaggaaattttaatattatttcgtcaaatatatttgtgttttgtggctttttcatcatatagtagtatcttgctatacagttgattcttgcagttataagctcacttaaatatgttagacacatatcttccgtaacaagtcccatgtaattgcttccttcctctggctttaataaagcaattcctactaaaatctccactatatcacatttaataagttctttagagttttgttgtttcttttttagctcatataaatagatggctaaatctctaatagaagtccaaggtaaatctaaatcaaccttatctaaatcttctttttttaatttccatagggggattttttcatcatctaacaatacttcatattctaagcaaaattggtatagtatttcataaacatccatatttttcacttaagatttctttttgaaatttttaaatttttaactaattttaagaagttaatattcactttcaacaaaatttttaataagttttaagcccaaatctgggaattttaagttatctgattcagttaatatactctccggatggaactgaacaccttcaattggtagctttttatgcctaactcccataatatagttatcatctaaactcttagcagttatttttaactcttttggaacttctttagctattaaagaatgataccttcctccatagaatggattgggaatgtctttaaagataccttctccatcatgatttattaaacttgcctttccatgcataactctctttgctctcccaacctctccaccaaacgcctcaacaatacactgatgtcctaaacaaactcccaatattggaatatctacctcttgaataatctttatacaatttccagcctcttttggagtttttggtcctgggcttataattattctatctggatttattttctttatttcatctaatgtgattttgttatccactaacttaactttataccctaaagtccctacatattggactaaattccagacaaatgagtcaatattgtcgataacaagcacttttttaacctccatttaaatcaatcccccaaaattgtcccatcctaacattaaaatataagacataattataaaggataataatcaccttttactataaaaatcttaaaaatttagtacaaaaaataattaaataattttacatcctacatccttcctgggcaatttattcctaacaattctaaacctgtctctaatactgtcttagtgcttttaaccaactttaatcttgattttttaacatcatcatcaacttttgtcattaaaattggacagtttgcgtaaaatctattgaatgccttggcaagctctaataagtagttggctaatatatgtactcttctactttcagcactctctttaattatatccttaaattcatccaacatcttaattaattctttctcctcactggttagttcatagttaaatactgcttcatctttaactcctttattttccgcttcttttaaaatactgcaacatcttgcgtgtgcatactgtataaatggacatccaactttttcaaagtctaaggcttcttcccatctaaataccattggcttttcaggagaaattcttgcaatgttgtatctaactgcccctaatccaatatcataggcaatattttcctcaacacctctcttattacactcttctttagccctttttatcgcctcttctaacaactcatcggtacttataaatcttcctcttcttgtactcattgaaccttctggaagggagatgaattcatagaatataacttctggcactttgcttccaaggagttttaaagctgctttaaccatctctgccgttaatttgtggtcagcccctaagacatctattcctatatcgcactttgataacttatctaagtgataggcaatatctcttgttgaatacaagcttgttccgtttgcccttgctaaaaccattttcttttcaatgccaaagtctgataaatcaagcatataggtttcttctttaattacctttccagtttccattaatttttctataacctttttaaccattccatttcttacataagagctttcccaaacaaaggtatcatgcttaatatttaaattctttaatgtctcttttattccatccaatgcataatttactgcaaattcaaattttttagttatttcattatcttcattgttttctaaagcatcttcatactttctcattaattcaagaatcttttcttcctcttctggatgctcttccaaatatttattaatttttacataagtttcagcaattgcatggtctttctttttttctttgtctaaaccaaataattcaattccataaacaaccaaagccatctgcctacccatatcatttacatagtagtgggtttcaacatcatatccatagaattctaatattctctttaaacaatctccaataatggcatttcttaaatgtccaatatgtaaaggcccatttggatttgctgatgtatgttctaagatgatttttatagattttttatctcctctaccataattatttccttttttatcaatctcttccattaaatttttagcaaatttgttataatcaatatagaagtttatatatccattgactgcctttatctctttaactccttcaatgttcatagcttttaacttatctaccaactcttcagcaataatttttggattcttttttagctctttagctaatctgaagcagatatttacagaataatctcctaactctaagtttggtgttttatccaactttatgtcaatctctttacatatctctttgctaattacttcttttaatgcattgatgatattacttttgatatccatagtcttccctctctcattttttatttaatttaaaaattggggattttctttaaataccttctttttaatttattaatttaaataaatgatagaaaagtttatatatgaagatgatattataagaacactgctacaatcaatcatcaaataaacttatttactatggaaaatataaaaacccaatgggtttttaaataaatttaattacatacctaaactttgatgattgattgttttgtgggctggtagctcagactgggagagcgccgcattggctgtgcggaggccgcgggttcaaatcccgcccagtccaccattttttgatttctaaaaggtttagttttataattttataaaatttaattaaaatgtttaaatatttacattaatgtgttatatatcttttgaataacttcaacttttttaacaacttcaatagcatctctacctaaaactctaatcatcggctcttttccttcccctcccctatcataaataatgtctggaactccaccaaatttttcacaagctatttttgttccccattccatagttgagacatttggcggctcttcttttctatcaaatgaagaaactgcaaatttatccttcaacaactttattaaccccccatcatattttatattcatgcaagcccttatctctgggttgaatttgcttgcagataaaattatctttgctatatgctcagaagctccaaactcaatatctccaacaatataaaaacctccaagcttattttttattatccttccagttaatgcagcaacatccttaaaatcttttggaaatggtagagactcagctatattactaccaacctctgggattaacgtaaagttcatcttttttaataaatatatggcatagctaaggttttttatcactttttctttattgatataagttgggttagagttatagccaaactttgattttttggcatagataactgaagataaaacaaatctctttgcctctttaattgcctcttctaaatcatagcccttagataaaaaagcagttatagctgttgaataaacacaaccagttccatgaacttctttatcaactctaaatcctttaaatgtctttataggtttaaaatttttcattaaaatgtcatcaatgccagtagctaagatgtataaatcatttctaatcatcagattgttattttttataaattccatgattttcttatattcttctttgttaggagttattaaaaagctcttattaaaaagctcaatatatttttccatcaacttttcatcaacaaatgaaaactttgttgtagatgcaagaaccgggtcgcatataacttttaaatcatacttgtcaatatattttagcagagtatcgatagctggttttgttaaaactccagtcttaacatattcaatatcaaactcctcaaaaacggccttaaactgattttttatattctcctctggtaaatcaaacttttcataaaccattttattattttgaggaattactgatgttgttattgttgggcaataaactcccaatgtatgggctgtttttatatcagcagagatgccagctccacttgtagggtcgtagccaccaatagctaaaataaccattaaaatcaccaaaattttataatgatttcacatttatctctcttaaacacttcataaccctctctatattctcctctaaaaattcaattctctctaagtcatctttaatttgctcttctttaatttctccattagctattttctttttaagctcatctttacttttaacattatattttttaaaaatttgatttaattcattctcaagatctttcagctcttctaaaaatacctttttcattgagtttattattaatttttccatacttaaccctctctatagaattcaattaaatcctctaatttttttaacgctttaccttcatcaatggatttttcagctaatttaataccctcttcaacatctttagcctcttcagcaatatatagggcaaaggcagcatttaagacaacaatatccctcttagctccaacctcctcaccttcaaatatctccccaattatcttggcattttcttcagcatctccccctctaatatcttctaacttagcttttttaatgccaaaatcctctggttcaatgtaatagctttttatctccccatttcttaactcagatatttttgtttttcctatagtagtgatttcgtccattccactaccatgtactactaaagcccccttcaatcccaaattctttaaaacatttgccaatttctccgtcaatttttcatcataaactcccattagttgataattagcgttagctggatttgttaaaggtcctaatacattaaaaacagtccttatccccaactccttcctaactggtgtagcgaacttcatcgctgggtgaaagtgaggggcaaacaaaaacccaatgccaattttctctatagattctttaaccctctcaataggaacatttagattaactcctaatgcctctaagacgtcagcacttccacttttactgctcactgctttatttccatgctttgcaactggaacataggcagagactacaaaggctgtggcagtgcttatattgaatgtgtttaaattatctcctccagttccgcaagtatctaaaagcttaggaacattaggatttatttttagtgaaaattctctcataatctttgcaaaggcagttatttcttctatagtttctcctttcattcttaaagctgttaagatagcagctatttgtgtaggttttgcatttccactcatgatgtctttcataacagcctctgcctctttttcatctaaatccttaaattcaataaccttttttaatgcctcagttatcatgttatcccctttctatctttatagtataatgcaactgcccttattgaaaacacacctaaatagaaatcaacaaatgttgataatgcgtaagatattccctttattgatatataaattattgttaaaatactgttagctaatgctgaatatgagataaatatatcaataatattaagtggtaaaacaactattagacttattataaaattaataattgctatgataatcactaagattatgtatcttatcccaatcatcttaaatatttctttaaattcaaagaatccataaaatcctttaactgaataattaacctctgccaacttagaataaagccataaactaattactgaaattataaaaattagtattgagattataataaggaaagccccaataattttgctaatgtatagtgaaaatattccaaaaacaaataaaattgctgggataaagtaaaatataatatttaataaaactaacccaacaatatatagtattcccctatacagcaaatcagtaatgttattccaatcaggagctacatttaatccttcaacagtagtcttcataattctcacattgtatcctcctataatagcagaaacaattagcccaatgataaaaattatcccaaaataaattaaaaatgacattataatatgcataatgtcataattagccctttccataaataaatcaataaatgcagtagtgactccactcattgctccaactatggcactcattaagcccccaatacataactttttaaagttaaagataatatagttatatgagttcgttaaataactctcaatagttcccatataacttcacctccaagtttattataaaaattcataattaaagtatttaaaaatatctattaggtgataatttgttatataatatggatgagagatttgaaattaaagatattgttgcaagagaagtaattgactcaagaggaaacccaacagttgaagtggaagttataacaaaagggaatggttacggttcagcaattgttccaagtggtgcatcaactggaacacatgaggcattagagttgagggataaagaaaagagatttggtggaaaaggagttttaatggctgttgaaaatgtaaattcaataattagaccagagattttaggttatgatgcaagaatgcagagagaaatagatacaataatgatagaattagatggtactccaaataaatcaagattgggagctaatgccatattggctgtttctttagctgtagcaaaggcagcagcagcaacagcaaaaatccctctctataaatacttggggggatttaactcctatgtcatgccagttccaatgatgaacgttataaatggaggaaaacacgctgggaatgatttagatttgcaagagttcatgataatgccagttggagctacatcaatttctgaagctgtaaggatgggttcagaagtttatcatgtcttaaaaaatgtcatcttagaaaaatatggaaaaaatgctgtaaatgttggagatgagggaggttttgctccaccattaaaaacatcaagggaggctttagatttattaactgagagtgttaaaaaggctgggtatgaggatgaggttgtctttgcattagatgctgctgcctcagagttttataaagatggatattattacgttgaaggtaaaaaattaacaagagaggagcttttagattactataaagcattagttgatgaatatccaatagtctcaattgaagacccattccatgaggaagattttgaaggctttgcaatgataactaaagaattagatatacagatagttggagatgacttgtttgttacaaatgttgaaaggcttagaaaaggtattgagatgaaggctgctaacgctctgcttttgaaagtcaatcagattggaactttaagtgaggcagttgatgctgctcaattggcatttagaaatggttatggtgtagttgtttcacatagaagtggagagactgaggatacaacaatagctgatttgtcagttgctttgaactctggacaaataaagactggagctccagcaagaggggagagaacagctaaatacaatcagttgataagaattgagcaagagttaggattaagcaaatatgctgggagaaactttagatgtccattttaaatttttctaattttttaatacctaagttttaaggttttcatccaatctttcctaaaagtttctttcaaaatgttttacaagaaactatatttcaactttttttctattttaatgtttaattaggtgagattatggatttagaaaagttaataaaaattggagaaaaagaaggatttgaaactgaagttttatttgttaaatcctatgaggttagtgttgatttagatggaaagagtgtagatagctttcaaactggaatctcttacggtattggagttagagttataaaggatgggaaagttggctttgcctatgcaaataaatttgatgaaaatattgtttataaagcaatgaaaaacttagttgaagataaatatactgaatttgcccatccacaaaaatataaagaaccaaaaggaatgttttataaagaaattttggatttagatgaagaaaaattgttagaggatttaataaccatgagagatattgccttagataataatgccattgttttgagtggaggtgttagtaaagaggttggctatgcaagattgataaattcaaacggcgtagatgttgaagaacaagatacttatttctctgcggcaatatctataatgtatgatggagaaacatcctatgaatgtagaacaaggcacaacatttttgatgttgaagaaattagctatagggcattggatttagctaagaagtcagcaaatggaaaagccatatcttacaaagggaatatagttttatcaccaagggcattgtatgacttgttatcctatacgttaatgccagcattcagtgctgaaaatgtgcagagggataggagtgttttaaaaggaaagataggagagcagatttttggagagaatataacaataattgatgatgggactttagattatgccctatactcatcaaagtgtgatggtgaaggaacagctacccaaaaaacagttttggttgagaatggagttttgaaaaactacctatatgatataaagagagcaaatagagaaggaaaaacatcaactggaaatgcttcaagaggttatcgctctttaccttatgtttcaccaacaaactttattattaaagaaacaaaaaatagcttagatgattttgatgagtatgtttatatcaatggagttattggctctcacacatcaaatccaataactggagattttgctgttgagattcaaaactcatactattacaaaaatgggaagataattccaattaaaagaggaatgtttggagggaatatatttgagatgtttaaagaagctatcccattaaacgatgttgaacagagagggaagttaatttctccttcagtagtgtttaagggtgaaattattaattaataaatttatataaacaaattaaacaaaacctatatataactttttggcaatatatgtagttaaaaatatacatattagtattaggatatagtatatttattttaattggaaattacatgtaattaagagattacaaattttgtttgtaggtgaaataatgccaatgggttttggagtgcattatgtaggtagtgaaggagtcgcaataaatcccttttacgatattctttggatgattatttttgtagtaatcattgcggtaataatatatatcctaatctctccattaaaaaaacagtcaagttcaatagacaatgagaaacttataaaaatagagaaggatgttgaggagataaaagaaatagttaaggagttgaagaagaaatgggaagagatagagtgattttatgaagttgatagatgttgtaaaaatgggagaggcattgtcaaatccaataagggttaagatattatacatcttaaataaacagccaaaaaatatttatgaattagccaaagagttggaactatcaagacctgttgtctatgcccatttaagaaaattggaagatgctgatttagttgagagtgatttggttttagaaggaagtagagctaaaagaatatataaagcaaaagaatttaagttctatattgacaatgagattataaaaaaattatttgaaaatgaatagctattcttttattctttcaatctttcttttaaataatcaacgagctcatctattttaactctaacttgttctcttgtatttctctccctaacagttacagttctatcctctaatgtttgtccatctactgttatacagaatggaactccaatttcatcagctctcatatatctccttccaatagctccactgtcatcatactcagctataataccattttctctcaacatttgctctatttctttagctatttttggcatatcatctttattaaccaacggcagaacataagcttttataggggcaattgatggttttaaatctaaataaactctatcttcttcctctctgtaagagtgttctaataaacagtaggttattctatcaattccataggatggctctataacgtgagggataactttctctcctttaataacttttttaacctttttaatttcaacataatcctttaaaatctcaaattcctttccatcaatgtttattattacttttccatcattttcaatgtttttaacaaattcttctttttctttttcacttaagttgtttatatatgcctcaattgcctttgtatctttcttaaatatctttccaacaactttataatttagatttatttcataagtttcaatctctctttcttcatcaagctcaacaaatactgagagttcaactccactatgagcagagtggcttcttaagtcataatctgttctatctgcaatcccaacacactcaatccatccaaatctctctgtgtatatttcagcatcccaacagtcaatagcatagtgtgccatctcatttgggaggtgctgtctaaatcttattttatctttatcaattccaattgcttctaaaaacctctttgttagagctataaagtaggcaattgtttgatgccttataattcctttctcaacagcctcaccaatacttatcttaattaccttttcatcatcacttaagttttcatccatctgcctttcagccggtaataatggaacaacttcatctttaactaaatcaaatttctcatgctcctttctctctggatggacaaaatattcaatctctgcctgggtgaattctctcaacctaataactccctgccttggggaaatctcatttctataacttttaccaatttgaacaacaccaaaaggcaatttatttctaaagaattgggctaatctcctaaactgtataaatattccctgtgctgtttcaggtctcatgtatccagttctctttcctcccggacctatagatgtgacaaacattaagttaaatttcttaacctctccaagctctcctccacactttggacatcttatattgtgttttctgattaattcatctaattcctttaatgtttttccttctgtatctacatctacaaattcttcaattaagtggtcagctctaaacgactctaagcagtttttacactcaacaattgggtctgtaaagttatcaacgtgcccagatgcctttaaaacttcataaggtgttactgttgggctttcaatctcataaaatccttctttaataatatattgctctctaaactttgatatgatgttattttttaataaacatcctaaaggtccgtaatcaacaaatcctgcaattcctccatagatttcaaatgaactccataagtaacctcttctttttgctaaatccataattttttcgtaaatatctttttccattctctcaccaaagtattgtctctctcttatctattctgtctaatataaatatcattaaacttgatgcaattaaatcagcagttgttccgggatttaatttatttccttcttttgataaatatttgtcaaattctttgaccttttcttctttaaagttatttaacacatcttcagccattttagaaacttttaaggcagtttcaaaacctctctttcttgcaattaatgtatcaggatatttagccaataggtttaaaaatgtttttgttacagctaagttgatattgttgagctcatcataatacttttttaataaattatagccttcaaatgagattttaaagttatcaacccattctttgcttatattatcccattctgcagatattttataaacatccaaaagagttaatcctttttcaataagttctttttttgcatcttctgaagtaacatcaggccctttctttggtttattaacataagccattgctatatttatagcatcataaacatttaaggcatcttcaacagttgtattttcagcaatcttctttaaattctcttttaatttattttcatcaaaattttctaattttccagcagccatggctatagggatgtgtagcattataattcctaagttggcattagttggagaccattttttactctcaataactgctttttttatgtataaaccaacatctctatctttttgagctgcttcataaacaacatttccaaatgcaattccagcatttataaagtgatgatatttgatgtctctataatccctatttctatgaacatttccaggtttaaaggagctaacttctaagcaacaggctatttgagaagctttcattatatcaaagggattcatgctttcaccaaaatttttatatatttgggaattaggtaaatgcatatactataggtgggaacaatgaatgtggttggattggctatttatctttacgctggatttttatcttttatttttggatttatttcactatatgctttcatcaaatactcaaaattagaaagaaaaaataaggaaattatttatgtttatgtagataatttgaaaaacttttctccatatatgttttacagtattttattgacatttaccatagtatttgttatttttgctttgtttatatgctttgtttttaattttgacttatatttaggattaactatgttgttctcctactttttaattatttatttattttgctttaaaaaatatagggttgaaatatataaagatggcttttatggtgtctttcaaaattgataaaatttattaaggaagatttgaacgccttccaaaggaaggcattcattagtgccttggttattcaggaagttttgaaagacaccattttaaccaattttacacttggaaaggttttgatggctatgagaaaattggagatagaataaaattaattggtaaaaaatatatctctccagatgtatatttaaaagataaagatgggaaagttgaagaaatacttaaaaaacattttaaacattaattaaaggggttattatggatattgagttaattttattgatagtagttttatttcttactccttatttgatagcactctttataattttcaatcctccctattgtattttggattatcttctatacaaaaaatacagaaaagcaaaagaagaatggcactatataacctcaaccaatatgggaatgaatagaagcagatggatttttatattaatagtggaaataattgctttatgttctggattttatattttaataaatataaatcgccctcatgatgagatattaacattttcgcttatatttttgtttattgccatcatttatgacaaactcactcctgcctctggaactgttgagatttataaagaaggaattgcagtatatattaaaatattcaacactttaaaaccatttttaaaccgttatattgttttaccttggaagttttttaaaggatataaaataaaatctaaaaataacacaaaatatgtcattttagttccaaaatcaagattattttttagtatttatttaatagatagagatggaaatgttgaaaaaactattagaaaccatttaaatcctatccaataaaaactttttaaactcttcaaaagctttttttctgtgggagatttggcttttctcttctgttgtcatttctgcaaaagttctttcttcttcttctgggataaaaatactgtcataagcaaatccatatcctttacttcttatttcttctgaaactctacctttaacaatccctttaaataatctaaccccattctcatcacagtaaccgataactgttttaaaataggcatttctattgtctttaccttctaagagttttaaaattccttcatttcctatagtctcttgaacaaactttgaatatgttccaggaaatccatttaatgcctcaacaaaaaatccactatcttcaacaataactggcttttttaatatattataaacccactttgccccaaattcagcaacctcttccaatgttccctgaatttctggatagctaatttttatctgttcgatctctacatcttttaaatcttttaaaataatatttgcttctttaattttatttggatttcctgtagcaaaatagattttcatgatttcaccaagagttctttgcaaaacattttagaataaataaggtatatttttataaagagagtgtctccccagtttaacaccctctatcatcctttagctctgctacgtcaagagggctaacccactggggagcataatctatttaagattttttagtatataatttttcctttatagccattcatctaaaactgttgtttttttagtttttatgttatgttttaaatctcttttacttccttttggtggattaagtcttttaaattctaagttctcctctttcagcaatttttccgccccagtagttaaagagggagaaaccaaaattcctctaactttatcctcaccatatttgtttttaaaatattccacatacctttttagttgagaaactgcctgtaaatcagctctccttctctttagctctaagataacccatttattctctttatcttttcctaaaatatcaacgattccagtgggaatctgatactctcttgatatgggcttaaatccttcttcaatcaaatctggatttctaaaaatcatctctgccatctctgattcactaccccttagatttatctcttcataatcttcacagttaaaagcacatgcatgataaacttctgaaataacaacctttaactcttcttttggctttcttctaatgctttttaaaatgaaaaagttatcttcaacttcccatattatactacttccagaaggttgccaatttacaggttctctttttttatctttatgaattaaaaaggctccatctggttttattataatgactctatctccctcttctaactgacttttagctctgccttcataaaaaactttacatcgagctaataatattaatatatatttaaacacatacatatcaataaaattttctaaatctttggtagtaggattggttagatagaaaactttctccaatctcatcacctaaaaaatgaaattataattatgcttctaaatatttaaacttatattaaaaaagattatttgaaaattttaaaaatatttaaaaatttcgtttttaaaattgtaatctttattaatttaaattaataaatattattacctaaaataaaaatggtgcaggggaggggatttgaacccccgaacccctacgggaccggatcttaagtccggcgcctttggccaggcttggcgacccctgcaccgcaagcgaattatagaatagatgaactcatatatatacttttcggtttcgtgcaaaagataaatatatattaataagttttcccataattataaaaacctatttaaataggaaacatatttcctcctgaggtaaagtatgaaaaagttgaagaggctgacgttaattttatacaactcctatgataaaacaagatggcatgaagctcacaagagagctatagcaagagccgccccaatctgttatgcgtttgattgtaacttagcgataatggactttccatgtaagatggaggatattttaaatataaaaactactattggtaattctggggagtatttagaaaaattaatcgaaaaaaatagattttttattgttgataaatttctaccacaatttggaattccaattgcctcaacatccaaaccagatgaaaaaaaggctataactccgttagatactgcctatttattaaagaaaaaaccaattggcgtatatgttggattgggtaggcatggactaccaaaagatataatggaatcttgtgtctatcatttagatgtaactgaaaaaagggtgtctttagaaacttgcactgctattggcagtattccagctgtgatatattgctatactaaatacatttgatattaaaaatatttgatagagtcagagataaaaaattttatatacataaccctattttaaaatattaccaataactgcaggtggaagtatgagcgttagtgttatggaagcaataaaagaagtaaaattagctgaagaacaggcagttaaagaaatagaggaagcaaaaaatagagctgagcagataaaagcagaggcaattgaagaagcaaaaaaactcattgctgaagctgaagaagaggcaaaaaaacttgttgaagagatgattaaaaaggcagaggaagaagcaaaaaaagaagctgaaaagattcttgaagagacagaaaaagagataaaagaaatcatatccattgccaaggttaagatactttcgttgaaattgtctgagattcttgaaatttaaataaaaaggtgattttagtgagacccgtaagaatgaagaagttaaaagcggtgatattggatgaaaaaattgataatgttgtaagaagcttacatgaagaagggatagtggaactctgtgatttatctgaaaagttggaggatttagaatggaagacattgttatcaccttcatcatcagctgattatgttagaaatgttacatcattgatgataaaagcaggtagaatattggacatgttttcaagtgttagtcagaaggagacaagtataaaagatatcttaaacccaaagccagtggaaaagaagaaagtttccttcaactcatatcaggaagttattgattatgctgaaaaggtattaaatgagattagcaaagaggttgatggacctgctgagagattatcagagttagataacaaaaaatcaaagttattacagctgaaagagcagatatcttatttaaaaggtttagagtttgatttaaaataccttggttctggagagtatgtatttattggggcaggaagtgttcctaaggaaaagcttggagaattgaaagcagaacttgataaagtagcagatggatatattggaatattctctggaagtgaatttgaaaaggataagaagattagggttccaattgtatttgttacattgaaagagaagcttgagaatgttttatcagagattagaaagtttgagtttgaaagatatgacataagtgatgttgaaggaacaccaagtgaggctctctcaaaaatagagagtgaattaaaggcaatagaatcagagagaaacagcttaatagaaaagttgaaagcattagcacaaaaatgggaaaaggaattgttagctgtttatgaattgttatcaatagagaaggcaagaggagatgcttattcacaatttggtaagaccgatagaacatactacatagaggcatgggttcctgcaagagatgctgaaaaagctaaaagcttaatagaaaattcagcagatggttttgcatttgttgaaataactgaaccagatgaaccagaagagaaaatacctgttctacttgacaatccaaaggttatcaaaccatttgagatgctcacagagatgtatgctctaccaaaatacaatgaagttgatccaacattattgctggttcctggtttcctattgttctatggaattatgctaacagacgctgtttatggtttgctattgactataataggtttatttatttggaaaaaaattggaaaagttagtgagggagctaataagcttggttatattctaacattggctggaatttcaacagttataatgggtattataactggaggttatttaggggatttcacctatgagttctttggatttgatgtaacaaagacaccattagctttagtcaatccactaggagaaagctactatataaataacaacaacccattattcacccttggtagtataagcgtaacaaatgggccaatggcaatattagtattttccatatttgttggattaatacacctgttaattggattatttgttggattcaaagagaacgtaaaaagaggaaatatgggagatgctttcatcaatcagggagtttggatattgctgatattatcaatattcgttggaattggattaatgtttgctggagcaaatacaatgatagctggaggaataatcggaatctttgttgtattggcaatcttagcttcaatgtataagggttataagagcggaggagtaatggaagcaattcttggagctatggatgttactggattcttaggaaacgttttatcatacgcgagattgttagctctctgtttagcaactggaggtttagcaatggctgttaatattatggctaagcttgtcggtgaatccattccagtaattggaataattgtggctataatcatattgttggtaggacatacatttaacttcgtaatgaatggtttaggggcatttatccactcactaaggttgcactatgtagagttctttagtcagttctatgagggtggaggtaaaaagtttagcccattcaaggcaaatagagaatacacaactgcttaacttctttcaagattatttaaatctttccaatactcaatataacaataaaatataaaaacaaaaaatacaacttaaaacttagacaaaaatgaggtgatattatatggtagatcctttaatcttaggagctgttggtgctggtttagcagttggtattgcaggtttaggttctggaattggtgcaggtattacaggagcaagtggtgctggtgtagtagcagaagaccctaacaaatttggtactgctatcgttttccaagcgttaccacagacacagggtttgtatgggtttttagttgctatccttatcttgttcgtctttaagacagtttcaccatgggcaatgtttgccgctggtttggcagctggtttagctggattatcagctattggtcagggaattgctgcttcagctggtttgggagctgttgctgaagataacagcatatttggtaaggcaatggttttctctgtccttccagagacccaggcaatctatggtttgttaatagccatcttgttattagttggtgtctttaaaggcaatgcaggagctgaaactgttgccgctttaggggcagggtttgcagttggttttgctggattgtcagggattgggcaaggtattacagcagctggggctattggagccacagcaagagacccagatgctatgggtaaggggttagttttggcagttatgccagaaaccttcgctatctttggtttgttgatagcaatcttaattatgcttatgataaaataaaacactcagctccttctttgaatttaaaaatttttataaaaatttaattttaacaggtgaaattgatgggagttgataagataaagtcaaagatattagatgatgcaaaagctgaggctaacaaaatcatatctgaagctgaagcagaaaaagctaaaatcttagagaaagcaaaagaagaagcagagaaaagaaaggcagagatattaaagaaaggagaaaaagaggcagaaatgactaaaagcagaatcatctcagaggcaaaattagaggcaaagaaaaagttattggaagctaaggaagagattatagagatggcaataaacaaattaaaagaggaacttgttaaactgccagaacagccagagtataaagataaattaataaaattaataaaagatggagctatttcattgggaggaggagagttgattgtgaggttaaacaaaagagatatggaacttattgacgattcaacactatggaacttagaaaaagaagtagaaaacgcaacaaagaaagtaactgtattaaagaaaggagaaccagtagatattgctggaggatgtataatagagactgctgatggattaaaatcattggataacagcttagaagcaatattcaacagaaacttaaatgtaattagagcgagaattacagaaaaattattctaaaataacaagatactaattgcctctctaatgaattcggtatttcaatagggttttcctatggagggcgagaattacagagaagttgttctaaaggtgatgcctaatggcgatggatatagagacattgttagatttggagaagttatactctgctataatgacatattttgataaccctttaacattgcttattgttgtagcaactataatcattgttcttattgtaatcgtatggattacaaagatggtcattgatttagctccttatgcttatgttaatgcaagaataaggagtaaagaagcaaaattgtttgatgatgctaaattaaatgaattgattgaatctggcagcttagaagaattagttggattgttagaagatactgattacgggcaatatgttatagaggttatgaacgaattaaaagaccctgttgctgttgaaaaggcattagatatgtatttagctgacttgtatggattgatatatagaatatctccagacagtgcaaagaaagtccttaaagtatttgccaaaaaatttgatatcaaaaatataaaaacattaataagagctaaattcgtaggattaagtgctgaggaaacttatgctttgctaataccattaggaaatatacctgttgaaaaattaaaagaattggctgaagttaaaacagttgaagaagttgttagaggtttagacggcactgaatactttaagatattgcaggaggagttatcaaactatgatcaaacatctaacataataggatttgagttggcattggataaatactacttagagagtttaagaaaaaccataatgactgaaggtaaagaagaagatatctttagagagtttgtagggacaataattgatgttgaaaacttgaaagttatattaaaaggtaaagcagacggtttatcagctgaagaactaagcaaatatgtaactttaactggctatgaattggctgattggaagttaaaagatttgatgagtgctggaggtattgagggagttttaagcggtttagaaggaacaagctatgctgaagttttagctgaagcaatggaagagtatgagaaaacaaaatccatctatgcatttgaaaaggcattggataaatttgtattagagaaaggtaaaaaactatcaacaagaaaaccatttggtgtaggtccaattattggcctgattgttagcaaagagcttgaagttaaaaaccttaaggcaataattaaaggtaaaatagaaaacttaaagccagaagaaataaggtctctgcttatatcattgtaggtgaggtaaaatgaaagttggcgttgttggagatagagaaaccgccattggttttaggctggctggtttaactgatgtttatgaagttaagaatgatgaagaggcagtaaaagcaattaacgagcttgcaaacaatgaaaacatagccttcataattatcactgagaggatagctgaaagtataaaagacaagttaaaaaatataaataaggttatcgttgaaatcccagataagcatggtaagcttgagagaatagacccagttaaagagttaataagaaaagcaattggagtttcaatgaaataatgataactaagattacgataaaaccaataaaaacgttaaatgaaaagagaggttgagaatatgccagttgttggtaagattattaaaatcgcagggcctgttgtagttgcagagggaatgaaaggagctcagatgtatgaggtcgttaaagtaggagaagagaaattgactggagaaatcattcagttgcacgatgataaagcagttattcaggtttatgaagaaacatctggaattaaaccaggagagccagttgttggtactggagctccattgtctgttgaattagggccagggatgttaagagctatgtatgatggtattcagaggcctttaacagcaattgaagagaaaacaggttcaatctttatcccaagaggagttgatgtccctgcattaccaagagatataaaatgggaatttaaaccagtggtaaatgaaggagattatgttgaagaaggagacataattggaactgttgatgaaactccttcaatagttcataaaatcttagttccaattggtgttaaaggaaaaattgttgaaataaaagagggtaaatttacagttgaagagacagttgcagttgtagaaacagaaaatggagaaaggaaagaaattacaatgatgcaaaaatggccagtaagaaaaccaagaccatataaagagaaactacctccagaaattccattaattacagggcaaagagttgaagacactttctttacattagcaaaaggaggaacagcagcaattccaggtccattcggttcaggaaaaacggttactcagcatcagttggcaaagtggtctgacgctgatgtcgttgtttatatcggatgtggagaaagaggaaacgagatgacagaggttattgaagagttcccacacttagaagatattagaactggaaacaaattaatggatagaactgtattaatagccaacacatcaaacatgcctgtcgctgcaagggaagcatctgtctatacaggaattacaattgcagagtacttcagagatatgggttatggagttttattaacagcagattcaacatcaagatgggcagaggcaatgagagaaatttcaggtagattggaagaaatgccaggggaagaagggtatccagcatacttagcttcaagattggctcagttctatgaaagagctggaagagttataaccttagggaaagataacagacaaggattcgtttgtatcgttggagctgtttcaccaccaggaggggacttctcagaaccagttacatcaaacacactaaggatagttaaggtattctgggcgttagatgcaaacttggcaagaagaagacacttcccagctatcaactggttgcagagttattcattatacattgatgatgttacagagtggtggaacacaaatactggtccagattggagacaattaagagatgaagcaatgagcttattacaaaaagaggcagagttgcaagagattgttcagttagttgggcctgatgcattgccagatagggagagagttattttagaagttgcaagaatgttgagggaggatttcttacagcaagatgcgtttgatgaggtagatacctactgtcctccaatgaaacagtacttaatgttaaagataattatgacattctaccaagaagcattgaaggcagttgaaagaggagttgaaccagctaagattttaggagtttcagttaagcaagatattgcaagaatgaaatacatcccacacgatgagtttataaatgttaaatcaaaagaaataatggagaaaattaagaatgaattaggttcattaaactaaattcctttccttaaaactttacaaactctttatttgaggtgatgatatggctacagcagcatcagcaattgaatactcatcagttaagagtattgcaggacctttgttaatcgttgagggagttgaaggagcagcttatggagagattgttgaggttatctgtccagatggagagaagagaatgggacaggttttggaggcaagagagggtttagcagttgttcaggtatttgagggaacaacaggattaagcacaaaagatacaagagtaagattcacaggaagaactgctaagattggagtttcaatggaaatgttaggaagaatattcaacggagcagggaaaccaattgatggaggaccagaaatagttcctgagaaagagttagatattaatggttatccattaaaccctgtttcaagaaaagttccaagtgatttcatccaaacaggtatttcaacaattgatggaatgaatacattagttagagggcagaaactgccaatcttctcaggttctggtttgccacacaaccagttagctgcacagattgcaagacaggcaaaggttagaggagaaggagagaaattcgcagttgtctttgcagcaatgggtattacatcagaagaggcaaacttcttcatggaagagtttagaaagacaggagctttagagagagcagttgtcttcataaacttagctgacgaccctgcaattgagagaattttaacaccaagaattgctttaactgttgctgaatacttagcttatgagaaggatatgcacgttcttgttatcctaacagatatgacaaactactgtgaggcgttaagagaaatctcagcagcaagaaacgaggttccgggaagaagaggttacccaggttacatgtatactgacttggctacaatctatgaaagagctggtagagttaaaggtagaacaggaacaataactcaaattccaatcttgacaatgccagatgatgatataactcacccaattcctgacttaactggttatattacagaggggcagattgtcttatcaagagagttgcacagaaaaggtatctacccaccagttgatgttcttccatcattatcaagattggctggaaacggacagggtccaggaaaaacaagagaagaccataaaaaagttgttaaccaggcttatgctgcctatgcagagggtagaagtttaagagatttagttgctgttgttggggaagaggcattgacagatagggatagggcatacttgaagtttgcagatgagtttgaagataagtttgttagacaaggaaaggatgaggatagaagtatagaggaaactcttgacttgttatgggagttgttagctatattaccagaagaagagttgaagagagttgatagggagttaattgagaagtatcatccaaaatacagaaagaaataaattctaaattttaatttttaaacttttttaagatttttgataatattaattttaatttatttttattcatttatatttgtatattgccatacttaagtgtgagagcatgggaagatgcaagcataatggtgaagttagtatttttggtgtaagaccagcaagctttcctaattttccatttcatttaatggataagattggaggttttgtgatattggatgagttatggttaaggagatggtgtgaaattatagaatatccgatgagaattccgacattatatgtgccaattgaggattatggtattccgactgttgaagatatggatttgattgttgattttataaaatatcatgtttctaaagaaaaggaggttgttgtttcttgtattggtgggcatgggaggacgggaactgttttagccgtatgggctggattaaatgggattaaaaatccaatagagtatgttagagagcgttattgtgagtgtgcagttgagacagaagagcaggaagagtttgtaatagagtatttgaaaatgaaaaagagagggtaactatcttgagaaatccatatttacaaaatgtagggtaaaaaatatttagtaggggataatacattaaataatagttaatgtgaaaataaggtttatgctttaatattaaataaaatgactgctatcttttttctctttaatcttcatactcaactgtggcattttttatattaaactccttccctccagataattttaatcttatacttttacactttgggcaatagacctcaaattcatctaaaatctctggttctccctcatatccacagtctaagcatttacactttggttttataaattcaacgttaattttagctccctcacatacagttccttcagcaataacttcaaatgcaaattttaactgctcaacattgataaatgttagttctccaacttctaagttgatttctgtaactttttttattttctttcctttttcttcctctttttttatgctgtttaatattgcttcaagcatggcattggcgtaagataattcatgcatatttatcccaattttagccctttaataacaatttccttaatccaactttttaaaaaggtttaatcaaaactataaaaatcttaataattttaaaatccgagttcgttagcgacaatttccttaaccttctcctccttattttttggagtaaatattttaaagttgaaaacagctcttataatatcatcaccatctacaactctacactctcccaaataagccttctgcttatcaaatctaacataaaatttgttatcctcaactcttaagtgtaaatctttcttcagtttatttatatttttatcatctgattttattaaatctataatatgtttaaatatcttcttagcctcttttccttcaacattgacattgataatttttattgggtttccaaagtatccctgcgtttcaacaacatctaagtctattttttcctcatcaacgttctcaggaataaaaaattctatcgcctctaaaaccttatcctcatcctctgtggcatgaactattgcactaagttttatagaatttagcatatcaacaccttttgagatttatgattatttagcgagattaaaatgaagacattttaatgttgagaaaatataatgtattatcaaaacttaccttataaaaaagaattataaaatttatttagctaaaacaatttcaatcgttgaaacattaacttctctaccatctgggttcttcactttatcagttcctatctctatttttttaatttttatgtcctttataaatctgtttcttatcatctctgcaacatccactgctttgttgatagcttttcctcttgcttttattatcacttcatcattgcttgttagctgtgttagaactgctacaacgtagttcatcactggcttcttccctatcaacactacattatccatgctctcaacctttcttgagttgttagattaaagatatatagaaataatttcatcatctatttaaacctttcatcggattttaaaaaagtttcattaaaagttaataggatatatcacaatatgaggctatgtcctattattatttttcatccaattaacgactctctttattccctcttttaaatcaatctctggcttccaacctaaagattctgccttttttatatccagataaattctatagacctctccctctcttggtttatcatatattgcttctcctctaaacccaatctcatgctttattatatcaaataattcatttactgatgtctcttttccagtcccaatatttactatctcattcttccaatttaaagccattaaattagctttagctacatctccaacatagacaaaatcccttgtttgatttccatctccaaaaataattgggctttggttttttaacattttatctataaatatgcttataactccagcctctccttttgggtcttgcctctctccatagacatttgaatatctcaaaattgcatattcaattccatataaacggttgtatagcttaatatattcctctcccacgtatttacttaacccataaggagataatgggtttattggatgattttcatctactggcaaataatttggttctccataaactgctccaccagaagatgcgaatacaattttatctatatcgtattttctcatcatctctaagatatttatagttcctaaaacattgatgtctccatcatatactggattttcaacagaatttctaacgtttatttgagctgcttgatgtataacaacttcaacatctttaaaattaattttttcatctaagtctttatctctaatatctgcatttacaaactctgcctttggatttatgttatttttatttcctgttgttaaattatctaagataattacatcgtagttgttttcgattagtttatccactatatgactaccaataaaacctgctcctccagtaactaatatcatttttccaccaacaatttaatttctttttaagtaattttttagtatattttcaacgcctttttcttttttaataactatcttatgtattggggttgttagtattatgtagttgtcttctattttaacatctttaaactccttccatgaataaagaactccgcttactaataacccctcttcacaaatataccctctggtttctccctttataataatgtataggaatactacaatccaacatattgcaatgaataatatatgagatattacaagttctcctgcaatatacagcattccaaagtaaaagcatagtaatgaaataatcaaaaaagaatttttaatcatattactctttaacatcttaggtaggtttatcttaacctctcttattattttaacttgtttctttatttttgaatatttgaaaattaaatatgctataaataaaaaactaccaattgttataattatggctataacaatcattattaaatccatcattgggatgttcataaaagccaccttattaaacaaattaaaaaattatgggaaataatataaaataaaaattattttgttatagctgttcaatcaattttcttcctgcttcttccattgatgtctcataaggtattccatgttcttccaatatttttcttccaatctcttcattagttcccatcattctaacagcaaactttacatttggatgttcttttaaaacttcaacaattccctttgctacttcatcacaccttgttattcctcctaaaatattaataaatattcccttaacatttttgttttctaaaacctttctcaaagccaattttacagtttcagcatcagcccctcctccaatatctaagaagcaagctggctttctgccgaggttatttataatatccatacttgccaaagttaaaccagctccattacctataactgccacatctccatccaactcaacgtaggcaaatggtaatttttctttatttttatattcttcaaattcttcatagttatgtctaaatgctgcatcatcatctaagtgaagaacagcatcagcggcatagacgtttccatctttagttataaccaatggattgatttcaaccattgtagcatccaactctttaaagattttgtataacttataaataacatcagcaacctttccaatctcattgcttggcaattttgcctctttaactatccatcttgcaatataagggaggaaaggttttctaacatcaatatggtactttataatcttttctggattcttttcagcgacttcttcaatatcaactcctccctcagttgagaagatgattaacggttttttagcatctctgtctatgataattgatacatagtattctttttctattggcaatttctcttcaactaaaattttttcaactttttctcctttaacttctttattaaacaactcttctgctttctttatgaattcttctttatttgatgcaaataaaattcctcctgcttttcctcttccaccaactaaaacttgggcttttaaaacaacttctttatcaacatttatactgtttaaatcatcttccttagatactaaaaagctctcaggaactgggataccatactttttaaatatatttttagcttcatattcatgtagtttcatcctatcaccttaaatgataaatttctttttaatgcaaaattttaaaattatcatataaaaaatttggtgataaatttataggtttaatgttgtcggtgatgagaatgcagattcctaaaacacatccaagatatgagtcattaatgaagagagagaagataattgaagctttagataaaggaattttagctaaggctggattgatagctcacggtagaggagagacttttgattatttaattggagaaaaaacagcaccaatagcattggaggcaataaaagctgctgctgctctattaattttagctgaaaatccagtgataagtgttaatggaaacactgtagcgttagcaatagatgaagttgttgagcttgcaaaagaattaaatggaaaaatagaggttaatctattctatagaactaaagagagagaattggctataaaaagagcatttgaagaaaaattcaaagatgatattgagacaggaaagataaaaatcttgggaatagatgatgcaaataagcagattcctaatttggatagcttgagaggaaaggtttcagaagaaggaatatttactgctgatgttgttttagttccattggaggatggagatagggctgaggcattggttaatatgggtaaaaaggttatagctatagatttaaatccattatcaagaactgcaagaaaatcaacaataacaatagtggatgagctaacaagagctatgcctttgttaattaaatatgttaaagaatttaaaaataaggatagagaagagcttttaaagatagttgaagattttgacaacaagaaaaatttgaaagatatgattgactatattgctgaaagattgaaaaatttaagcttagatgaattataggtttgggataaatatgaagatagtttggtgtattacaggagcggggcatttgttgagggagagcttccaagtaatgaaacgattaaaagaagaaattgaagatttgaaggtaactaccttagtttcaagggctggagaggaagttgtaaagatgtatgggttgtttggggaattgtataatatctctaatggaaattattatgaagagcttatattggagagagaacatccttactcatcaccaatcactggaagattgagcttaggaaagtatgattatttaatttgctcaccagctactggaaataccgttgctaaggttgttaatggcattgcagatagcttagtaacaaatgctatagctcaggcagggaaaggatttgttaaatctttaatagttccagttgattataaagctgggattgtaacaacaaaacttccttatgcaattgataaaaagaaatgcaaactctgtttaaaatgtataaacgtctgtccaaatggagctatagttaagagggataattttgttgagatattattatctaaatgcttaggatgtggaaattgtaaaaaagtttgcccttataatgcaataattgagggaaaagagattaagatgagggttagaaagatagatgctgaaaatacaagaaaattgatggagttggaggatgttattgtattaaagcatccttatgagattttggagttttttaatattagataagttttatttcttctttaatttaataatacatgtttcagctggctttaaattcatttggtagcctaaattatactttaaagtttcacttataaatccaattaacaatcctccccaagggcatgctgttccttcaaattcatagccacaaattctctttgggcagagattgcattttgatatctttactataatttcatcctcttcctcattcatctctatctttgcaaaatctaactggttaagaaatctttcaatatctttaatatccttaaattcataaccattattcattgcgtaaattcccaattcctttccagcataagaaccagccatattgcttaagctctgagctccatgtccagtaattaattttaatccaacagaatatcctataattaccgctgaaggtattgatggacagggatcgttttttgatcttctaattttatatagaaccatgttaccaccctgtagtgttttttatacagatgtataggaagatatatatgattataaatattatatacctttaaataattttatgagggatattaatggaatttattatcaaagctaaagggcataaaaatgtctcagctacccataaaacaaccttagagattacaaaagaggattatttaactccaacaggacactgcattataggaatagatgcagataaatctatgactgattttagtgaagaatttaaggaaaagcttagaaatgctaaaaaaataattgtagagattgaagttgaaggaataaaagacactataattggagaggggcataaagatttaattttaaaccatccaacagacatggttattagaaagagtaattatatatgcccaagaacactaatgattaatgcaaataaatcagcaaaagatattaatagagagatagtaaaaaaattaaaagaagggaaagagttgatttttaagataattgtctaaaggtgaaaagatgaagataaaagttggtgtcttaggagctactggaagcgtggggcagagatttgtccaattgttggcagaccatccaatgtttgaattaacagctttagcagcatcagagagaagtgctgggaaaaagtataaagatgcatgttattggttccaagatagagatattccagaaaatataaaggatatggttgttattccaacagaccctaagcatgaggagtttgaagatgttgatattgtcttctcagctttaccatcagatttagctaaaaagtttgagccagaatttgctaaggaagggaagttgattttctctaacgcatcagcttatagaatggaagaggatgttccattggtaattcctgaggttaatgcagaccacttggagttgatagaaattcagagagaaaagagaggatgggatggagcaattataacaaaccccaactgttcaacaatctgtgctgtcataaccttaaaaccaataatggataaatttggcttagaggctgtttttatagcaacaatgcaggcagttagtggagcaggttataatggcgttccttcaatggcaatcttagacaatttaattccatttattaaaaatgaagaagaaaaaatgcaaacagagagcttaaagcttttaggaactttaaaagatggaaaagttgagcttgcgaactttaaaataagtgcctcatgcaatagggttgcagttatagatgggcatactgaaagcatattcgtcaaaacaaaagaaggagctgagccagaagagataaaagaggttatggacaaattcgacccgttgaaggatttaaacctcccaacctatgctaaaccaattgttattagagaagagatagataggccacaaccaagattagatagaaatgaaggaaatggaatgagtatcgttgttggtagaataagaaaagacccaatatttgatgttaaatacactgcgttagagcataatacaatcagaggagctgctggggcaagtgtgttaaatgcggaatattttgttaagaaatacatataaattaaattaagaaaatatcttttttattctatttctttattttactattaaagatttggtagaatttattagtaatataatataaacgggtttattttgaaaaaacctttcaaaagattatttgttatctctacctgacaacgaatttttaaaagaagctaagaaagcgactcaagggtatgaagaaaaataaataatgaagcactgacgatattacgcaatattgataaatattatattgactgtatggataaaagatagttattctctccccaatatcttttcaaaattaacttcagttggatattttccagttacacaagctaaacataaatcttttctacctatagctttaactaatccctctaatgataaatatccaatagaatcaactccaatagctttccctatctcttcttctgttttgtttgaggcaataagttcctttttagtagccatatctataccataatagcaaggggatataatcttaggacagccaattcttaaatgcacctccttagctccagcttttctaaccatatttacaattcttcttgatgttgttcctctaacaatactatcatcaaccaaaacaaccctcttcccttccaatacactttttactggacttaattttaaccttactgccaattctctctcattttgggatggaagaataaaagttcttccaacatatctgttctttattaaaccttcatagtatggaatccctgactcttcagaaaatcctaaggcaaatgtgactcctgaatcggggattggagaaacaacatcagcatctactggatgttctttagccaaaatttttccaatcctctttctaaccttatagacgctaataccatcaattgttgagtcaggtcttgcaaaatacacatactcaaacatacaagttgccgctcctctgtatatacatggcacatcgacattcacagggttgtattcagaaacaccataatctaatttatgagatattatttccccgtctttaatttctataatttctcctggctcaatatctttaacaaattcagcatctaaggttgttaatgcacaatcctcagatgatatatagatattgctctcatctcttccaatacacaatggtttaaagccccaagggtctcttactgcaattaaggaatcattaaacattattaaaagtgaataagctccaacgagcttttttaatgtattttttattgcctcaatcttatcagatgtttttaacaattctctaaccaaaagttgagctataacttcagagtcagttgaagaagtgaatatatgccccttcatctctaattctcttcttaattcgtctgaatttactaaatctccattatgggctatagctatattaccaaatgaacttttaactacaaacggctgacagttttcaacagcctttcctcccgttgttgaatatcttacatgtccaattccaatatagccaaataagttttgtaatgtctcatttttaaaaacatctgtaactaatccaatatttttatagtagtgtatatttttcccatcacttgtagcaattccagccccttcctgccctctatgctgtaaagcaaacaacccataataaatttttttagctacatttaacctttcataagagtagattccaaatatcccacacatattaaaaacccttttttagttttttagacttttagcaaataaataaaaagaaagaagaaaattaagaagaattagtaaaattaaaaagataatttatttttattctaatattatatgcttatcattatatttaacaacagctttaccaacaatcttatttccattaacctctaagctatcaacaactctacctattacttgggctgggatattatatttattagctatttttataactttgttggcatcttcttcatcaacaattacacagaatccaatacccatattaaacgttctaaacatctcttcatcaggcacattacccaatctttgaatctctttaaatattggtaatggctctggaaggttgtcaatatagtaagttactttatcattcaatcttttaagctttctaaaacttcctccagttatgtgggctaaacccttaacttctatatctttatctctaatcatctccaaaactggctttacataaatccttgttggtgttaaaagctcttcagcaactgtctttccataagagagtttgtcattaatgtctaacttagctatgtcaaaaaataccttccttgccaatgataacccattgctatgtattccagagcttcttaaaccaacaatcacatctccagctttaacatcctttccagttatgatttcatccttcttaactattgctaacacagttcctgctaaatcaatacctttaatcatatctggtagtgtagctgtttcaccaccaacaatgtttatatttgcctctttagctccttcatttaatccttttcctatttgctcagctatctcttcggttatatgtccaactgctaagtaatcaaccaacgctataggctctgccccaatacagatggcatcatttacattcatagcaatcatgtcaattccaacggtatcaaatttattagccatctctgcaactatcatcttacttccaacaccatctgtagataaaactaaataataatctccaaactcaacagctcctgcatagtgcaatcctaactcagctggttttatatcacttctcttaaatgttatctgtgaaactaaggctttaattactttatcttcgtgagatatatctactcctgcatctttgtaagtaaccataatatctcctcattatttgtttcaataactatacgatttttgtaggaataaaaattttttaaacatccaatttgcattatggaatatttaaactacagaaagtcttatactattatctttttatctttttaacaaaacattatcccctacatcgacaccaatattttcagcaactggtttgcatttagctttcaatatataatagattggtttatctatcttatcttcatattctgttaaactttcataattacccattcccttagcaatgattaaatcagcactttcaaactctttcaaaaattcttctgaacactcttctaaaataattccaatgatatctgagccggttgttataaccttggctatctcatcaatcttggctatctttgcatcttctaatgtagcatcgtttagaattggttttcctttaactactgcaacgatatctttatcatattttttaatctcttccattaaaaccctatcaaaaataatctctccagcgttatcacatatatacaaaatcttttttatgtttttatcttttaaatcatttaagagctttctgctgttgtctatctttaactccccatttaatgtgtcttcaattaacttttcaatatttatccctgtgctgtaagctccaaagtcaataacgtttcctgcaattgttgctaaaaccttctttctcaatctttcaagctcatcatctgtattactcatctccctaactttatctaaatactgaagggctattttgtttgccttctctttcaaatttttgtaagggtcgttgttgttgctaattttctttaaatatctatgcactacagtccccatccatgctggaaccgcactctcaccataaacatctttaataacttccatagtactttttattaatctaaactgctctctttcatcatctgttatctcattagcggcatcaacgacctgccttattatacagatagcacattctggttttattttcacactctcaccatgaaatttaagaattagtaagaccaaattttaagataagttataaataaatcttcaaactcttaaacaatacggcgataaatatgattaaccttgaactatttaaagaattcttattaaaccttataaaggattatgggtattttggtatatttttggttggattttctgagccaatatttcaaccattcccaacagagatatttattatagcaggtattttattagggttagattggaaattagtttggcttatatcaacaattgcctgtaattttggggctgtcgttacatattatcttgcaaaaaagtatggggaaaagttaatgttaaaattatttgatgaagaaaaaataaaaaagggaagtcattatttaaaaaaatggggaattttgggagttataattgcaagctttacaccaattccttttgaggttatatgctgggtttgtgggagttttgaaatgccatttgagagatatatgattgcagtttttttaagtagattgattaggcatgggatggttattttaccatttgttttaaaagaccatattcatttttgataggtgcagtttatattaattagatttagttaaatacttaaaaagcaataaaaaacatttttattaatactaaaaacagataatttcataaacagaattttatattaaaagactgtaatttatttttggtgataaaatgtgtctggcaattccatgtaaggttgttgagattatagaggaagatggagagaaatacgcaatagctgaatataaaggagttaagcaaaaggcaaaattaacacttttagataaggaggttaaaataggagattatatattaatccacactggctatgctttagaagttttaagtgaagaagatgctaaattaagtttagaagcttgggaagaattgtttaaagcattggaagaaatggaacaataaaaaaagattttacaaaataacagaaaagaatttaaatttgctcttttattctggttcaacttttacagctcctgttggacagacatcttcacagactccacaataagtgcagtcatcaggtcttgcaacaactactttatctccctcaatttcaaaaacttccattgggcagttatttacacattctgcacactctgcccctttacataagctgtaatctattgttacagccattattaccacctctaaaatgttaataattgatttaataattgattaagattactacttgatatatataattatcggaaatgatatcggaaaacaataattaaaatttaaaataaaatatggagctaaaacctccttatatttggattcattatggttctctctatgttccaaacttcatttagcacatttgaagatagcttaggtcttaaaaaaggaaccttgaaactaactgcaatgtgagcaaatgatgagttatttccaaatattactggataaagccctttatccataatgtagtttatgtaataatacatctcagttattgttcccatttcatatgggaaaactttaacaaaatcactttcctcataaatgctgtccgtgcatagaaatccatcaaattcaacaggctcttcaacctctaagtaatcaatctgagataaatccttatctttaacagtttcctttttagaactaagtcccaataatatatctaaatcctcatcttctttaatttcatctatcaaattcctaatctttggaatttcattaaatatgtccttgcatgtgtatgctccatcaatatttacaatactataatcatgagataagacatctgtgagctttagatataaattaactatatcttcaatggaatcagccatgactattggaattaactcattcttatctttatcaactaatatgccagaagcaactattggtagttcagttgttaaagctccccctaaaaatttaaataaaggaatatctaagctgtttgaagccgctcttgctacgctaatagaaattcccattgctacagtaggattattaactgatgtttcacaaattaatgaatcaataaaatcaatgtcagttgctggatatccaatgagttctggggctataacattttcaacatcagctattgcttcctctggattattcacttcaatgatgtcatagccaatagaaatatttgtcattgttgtaatcattaccttaattttagctcctttaaaaacttcttttgcacttattttttcaataataacatttgtcaattacatccacctcaattaaaaaataattataatttaattgtttatgccttctcctatcagatgaaatcctacggatttaacaaaatcctttggattttgtagctcgaagctacgcttcggtttcattactcgcccatgggcgattactatacctcagagtggagcttcactacgttcagccccactgtagttaaaaacaattaagcttttaccggtcttattggttttaaaggaacttttccttgtttaatttcttcataagctattttcaatgagctatcacattttgtttctattgttgcatatgctccacttgatatctgcaaacttctcgctcccaatatccttgcaatctcaaattttgttaatttcaatatctcacctctgaaatatataaaatatcaaatggtggggccgccgggacttgaacccgggtcgcacgccccccaagcgcacaggatatccaggctaccccacggccccgttaaaaagaataataagtttaaaaatctaattatagatatctctcgtcatgagctattatttcatcaataatttctcttccatcctctcctattctgtaagagataaacattcttctacagcagtattttttaatgcctaaatcatccaaaacatcttttggattctctccttttaaaattctctctttgtactcttcaaaaacttcagcgataacattaccacaggaaaaacatctaatagggaacatcatgtttctcacccaaaataaaagaaaagataatatctttccaaaaattgtaaaataaatttatctgtatgacttttgtctctttgctcttggaccctttgttgacctacttggtttgtgtggttcggttcttcttgcatcgctaaccaataatgttctgtcgtaagctaagaacttgtctctcaactctttgctacctgtaaattcaacaatagctttaccaatagctgttcttgcagcatccatttgtcccattactcctccgcctttaactgtaacatcaatatccatttggctaataacttcctctccagctaataaaattggttccattaacttcattctcttatatttgggctcaattaactcaataggtattttgtttattcttattcttcccttcccttctcttgctactgctctcgcaatagctctttttcttttaccaactgttataacaatttttcccatttaatcacctcagaacttcgctcctaagtgtttgcttaactcagctaatgttatatatttggtggtgtttaatttgtggcttattttttcatcaactgttaagtttttaggatttccaacataaactttaactctcttaaatgcctctcttccttttggttttttgtatggaagcatctttctaattgttcttcttaatatatcatctggtcttcttgggaatttcggcccaaatcttcttgggttagcaacgtttttcttctctctttcctcttggtaggtttttataatccagtccttgttacctgtaataactaccatctcagcatttacaataacaatttcttctcctctcaaaactctttttgctacttctgaagccaatcttcccaatatcgctccttcagcatctattactgtcataactatcaccgtgttttaatccagtttatatttacgccataattttaacatttgaaccttttggatttctttttattagctcttcaattgttattgcttctcctccagcttctttaattaattttttagctgtttctgagaatgcaaatgcagcaacgacaaccttgtgctctaacttcccagctcctaaaactttaccaggaactaaaacaacatctccttcttttgtgtatctgtttatcttacttaaatttacctctgctctccttcttcttggttttgctaaccttcttgcaatatccttccaaatctttgcctgatttttataactttcctgctttaatatctcaattaacttaaccaaccttgggtttgtagctgttattttctttgccatatatatcaccgtgttttccttcaaaccttttataattattataaggtttgacaaataattagaatgaaaatggttttttattgttcaatcatttctaactgttgtaagaaactttcagctttattttttagtattttaacagcttcttctaagatttcttcagcttccatttgtccaaatgtttcaacgaaaaattctacttcatcatcagcaatttgtttatagacagcattgcatggttgccattttgcatgaacctttccaatgccaggaattgcttcacattcaatctgtattctttgcccttttcctaatttaacaattggaatgtttttaaaagcaacttctccattttcagattttaaatctgatgaataaactgtgcaaggcccctctttttctaaggtgaatgttataacttcattctctaataatggttttcctttaattggaattaaacccaatctatgtgctaaaatctcatcatccattgatgatgagttctcatatatataaacatcttcaatagcaaaggttggaacttcagaaatcattattctcctaatagcattagaaaatgaaattggggcttttaaagaaaaaataaattcctccccaattcttgtctttctcttttctttgattgtaatcaaagattatcaccttactttttgaacctcttcttaggtgttgttccatcatgtggaactggtgtaacatcttcaattcttccaattcttaatccagctcttgctaaagctctaatagcagcctgagctccaggtcctgggtttttctgcccactacctcctggagctctaactttgatatggatgttttcaattcctctctcttttaatacctctgccaatttaaatgctgcctgcattgctgcgtaaggagaaccctcatctctctggtttcttgtaaccctcccacctgaaactcttgcaattgtctctgctcctgtaatgtctgttgcatggattattgtgttgttgtaagatgagtagatatgaactattccccatttttcttttttctgttctgccatagtgtttcacctttaatttatatttttattctgtctcctgtgtctgtgtttcttctgctactaatccaacaattttagctctttctgggtgattgtcatcgttgaatggggagtttttagcatagctgattttgtcttcttcttcaactgttaccatgtagcttggagcagttacaactctaccattaactgctatatgtccatgaacaattaactgtcttgcttgtcttggtgttcttgctaatccttttctaaatacaagtgtttgtaatcttctctctaagatatcttcaacggttaatgataagacatcatcaagtgttgggttctcaatttttaagataccgtatttttttaatacattgaaaagctggacagcttctttagctccttgctctgttctatcactaattaatcttcttgcctgtcttctgtattttcttaatattgtctctgctttccaaacttctctctttcttcttaaaccatacttcctacacaactctttttctctctcaattctctctttaatccatggatggtttggtgtttcataagtctttttaaatcttctccttgggtctcccatctaatcaccttcaataattttttgttgaatgttatgctaagtgtttcatttaataatttatttctttcttcttgaaactccaacagttggacctcttctaaatgtactctttgttctctgtcctctacatggtaatccaagctcgtgtctaattcctctataacatctgattctcttcaatctgttaatatcttcctgttttataatcattaaatcgctttcaataacgtgtttatcctctccagtaacataatcttttcttctgttaaacatccatgatgggattccaaatttagcagggtctgccaatacttcttcaatttttttaacttcttcctctgttaaataaccagctaatttgttagggtctaatttagcaactcttacaattgcccttgccattgcctctccaacaccgtagatgtcctggagagccattattaactttttgttcccatctaaatctgtccttgaaactctaattaaatacttaaattcagaattttgcatattctcggtcaaggttgcacctccataatttcgtgttttatagtaaatagatattaaaaaataaaaagaagtggcgcggagggggggatttgaacccccgcggggcaaagccccatgggatctccagtcccacgccttggccgggctaggctacctccgctctgaaacgtgtttcattttttatatattctttttatatattcccacaatactcaacgttatgattaatggataccatattatatattattttcggtttttagtaaggttaaaggatagttattaatttgatgttgaagtatttatatctaatccttaaaataatttacaatggaactttcgtaggaataaatgttctatggaataataatgcctttaggcatttaaatgcctttaataaaatatacaaactgcgaaagttctattacaatataaaaatttaaaaatttatgctgatggtgtcattatgtcagtaaaggtatctgaatatatgacaaagaaggttgttactgtttcaaaagataatacagttaaagatgttattaaattgttgaaagagactggacacaattcatttcctgtggttgagaatggaaagctaatagggatagtttctgttcatgatattgtaggaaaggatgataatgagaaagtagaaaatgtaatgacaaaaaggaaagatatggttgttacaactcctgatgccaatataatggatgttggtagaataatgtttagaactggtttctcaaaattgccagttgttgatgaagaaaataatttagttggaattatatctaatatggatgttatcaggtctcaaatagagaaaaccacgcctaaaaaattggaaaatataatcaaaacttataaaagcttaggttacaatttgagagttgaaaaagaagaggtagatgttaataaattgagaccaacacagaataaaatacacgctgatgagctggttggcagaatgtatgaactaaaaaaaggtttggcagagccaataattgcaataaaaacaaaaaggggagattattatatattggtagatggacatcatagggcagtagcagcgtataaaatgggagtgccgaagttggatgcctatgtaatttatttagacactgataaaaagcttggtatagaaaagacagctgagattatgaatttaaaatcactggaggatgttaagattgttgatagtgatgacgaaaacagtgttaaggtaataaaatacaacaaaaatggagtattgggataattatgataattaggggaataagaggggcaaggataaataatgaaatttttaatttaggtttaaagtttcaaattttaaacgctgatgtagtagctacaaagaaacatgttttgcatgctataaatcaagcaaagacaaaaaaaccaatagcaaagagtttttggatggaaattttggttagagcttctggacagaggcagatacatgaggcaataaagattattggagctaaagatgggaatgtttgcttaatctgtgaagatgaagagacttttagaaaaatttatgagcttattggtggagaaattgatgattctgttttggaaattaatgaagataaggaaagattgattagagaaatttttaagattaggggttttggaaatgttgttgaaagagttttggagaagatagctttaattgaattaaagaaagagtaaaggtggaaatatgagagttattgatggtggagttacagcccctaagggatttaaagccaatggatacaaagagggtaagtttggagtagcgataattatctctgaaaaagatgcagtaggagctgggacattcacaacaaataaagttgtagctcatcctgtagttttatcaagggagttgataaaaaatagagataaatttagagcaatagttgcaaatagtggaaacgccaactgttttacaaaagatggaatggaagatgctaaagaaatgcagagattagtagcagagctctttaatattaatgaagatgaggttttagtagcctcaactggagttattggaagaaagatggatatgaacattataaaagatagaataaataaggtttataatttaataaaagaaggaaacagctcaataaacgctgccaaagcaataatgacaactgatacaaaaccaaaggaaatagctgtggagtttgaggttaatggaaaaactgttagagttggggggatagcaaaaggagctgggatgatagctccaaatatgttacatgctactatgctttgctttataacaacagacatagagattgataaagaaagcttaacaaatatcttgcaaaaggttgtagataaaacattcaacaacatatccgttgatggagacacttcaacaaatgataccgtttttgttttagctaatggattaagtggagttaattatgaagaatgtggagaagagtttgaaaatgccttattgtatgtgtgcagagagcttgccaagatgattgttaaggatggtgaaggagctaccaaatttatggaggttgttgttaaaggggctaaaactgaggaggatgcagttaaagcatcaaaggctatagttaattctttgttagttaaaactgctgtgtttggtggagacccaaattggggaaggattgttgctgctgttggatatagtggggctgatttcaacccagaagttgttgatgttatattgagcaactataaagatgaggtttatttagttaaagatgggattccattggctgatgaaggaactgaagagctaaaaaaggccgaggagattatgaaaagtgatgaaataaagatagttgttgatttgaagatgggggagtttgagaacgtttgttatggatgtgatttaagctatgagtatgttagaataaacgctgaatatacaacttaatggtttgtcacaatctatataactaactgcttacataagaatataacaacacaaaaaagaggatgatgttatggaaacggatataattatagcatcaattatgattagtttgtttttattggctatggtcttggttggctgtttgtggttgttctatgcctctaaaaagttagaagcaaaacctacccaataatcttttttatagcatactctattattaagtatattccaattgctattattatcattatgcttattccaactatggcagagtttggagctaaacccttatacaaactaaatagtatcatcactattataccataacacatggcattaatggcagtatcacaaaaattggttaaaatatcaaatttagctttttgtttatttttttaaatccattttagccataaaatccaacaatctacctaagaaaaacattgacaccaataaccacacaacaaacataatgatgtataatcctattaaataacctactggaagctcaaacactaagtagtaagcagttatcaaaataataccattagcaaaaactttaactattgtagtgtaatactttaaatgtctatcaaattgtttagttatcataatattcacaactcctaagcttttgatatggttaaggatatatattttttaggattaataaaagttatctaagctaacagtatcaaaattattagcttatgtggggggagggttatgttaagccctgacatgcctttaaaaaatttggatgaatatgataggttaggaataaagaagaaggcagatgctatagcaagatttattgaaaatagatgggattatttgcagaagaataatatgatagccctttatggaaattgaggtagtgggaagagtagcgttataaaccatattatgagtaaattggataaaaatgaatttatttgcttaaaatttgatgcttggctttatgaaaaagatgataatttgccttattcattattggagtttatttgggacgaattagaagctaaattaaataaggacgaaactattacaaaagaaataaaagataaaattaaaaaattaggaaagaagtcagttaatctttggaaaaacatggttttaggagcaataaatgcaacaaatattaaagcagggacttctcccataacagaactatctgggattaaaataaacgcaagttttgatggaagcaaatttgttggatacgtagtcaatgcatcaaaagaagacgaaaatgaagaagaatcttaccataaaaaagttaaagaattacagaattgttttaaagagttatcaaaaacacttgccgacaatggtaaaaaattaattatttttattgatgaacttgataggtgcgaagcagagaatattttaaatttattggcatcaattaagttattctttagtttaggcggagaagatgaagacgaaaacaaaaatgatgatgaaataaaaatattgtttattttgtagctgttgataaagatgctgtttctaaggctattaaaacaaaatataaagatattataaaagcagaagagtatttggaaaagatttttaatatttcatttagtatgccaaaatcttatgaattaaaggattttattaaacaatatgatttctttaatgatgataaaattgctgaaaagcttgagagattctttaaagctatcaattttacgaatccaagacatttgaagaaggttttaaataaatatgcaatccttattgagtttaaaaattctaaaattgataacgagagattaattcctgaaataataagaattgaaaatggagaaagaaaaagaaaaggatatttatttgatacagtttttgttttgtattttataattctttatgagttttattatgggaaatatttggaggttaagaggtataaatgtagattacaaacaaatacaggattacaatcttattttgaacgttattctttattatctcaaattatgaaagtaataaaaaatagaaatgctaatgacatggatagagtcatcaccaatttaatgctgttgtattcacaactgggctatagatataactatgaaattaaaggaagaaagttttataaattagtaataaacagggaaattagagataaggattacaatatagccaatgaattaagtatagaattaaaagaagccggaatcacagtagatttttgggaatatattaaaaacaactatgaagatttaatagaagagaattatccaaatccttatccatttacaaatctctttaaaatggtagaaacctatttataaaatcttttatccaaataagtaaatatcccctattaataaaaaaagaaaggtaaagaatttacttgattggaacgaacattgagcttcttgtagctcccataccaggagctccgtgctgaactggttttcttgttaatgagaactctcctaagtagtgtccaatcatttctggagttactttaacttcaacgaactcttttccgttatagacaccaaaggttaatccaaccatatctggtgttataacaaagtctctgcagtgtgttcttataattcttggttctttacctttgtttaataatcttcttgcttttttaattttcatagctaattttttctgttgtggggttaaacctctcaataatgttcttctctgtcttgcaggcaacaactttgcaaactctcttaaaggcatttgttgaagttcttctaatgtgtatcctctgtatctaaactctatcttttttgaaattacttgttttttctttttaattcttcttctccttgcagatgccatatttagtcaccttaaattattatgtgttttgtttgtgtttattttatctaattttattcaaaaacttaataaataagagaggaaattatttcctgactccagttcttcttgcagatatatgtccaacctttcttcctggtggaactttctttcttgaaacagtagttggttttccagtgtgttggtgtcttcctccaccgaatgggtgatcgacagcgttcattgcaactcctctaactcttggccacttaactgccttagctttcattgcgtgatacttcttaccagccttaacgaatggtttctcttttcttcctccaccagcaacaactccaattgtagctctacacattgagtgtaaagctttgatgtgtcctgatggcaatttaacataagttctttctccatcgtgtgtcaatatgtgtgcataacaacctcctgctctaactaattttcctccatctcctggaactgtttctatgttgaagacaggaattccctctggaatagctcccaatggtaagatatttcctggctttatttctgcagagacaccacactcaataatatctccaacttttacaccttctggaacaactaacaatccttcttctcctgtttcgtattcaacttttgcaactggagcacttcttcctgggtcgtgtaatatatcaacaattttacctaaaacttttccttttttctctaattcatcaaatcttctgtattttgcttctccccttcttttgtgtgaagggcaagtatatactgaagaacccctacctcttctttgagagattaatctttttcccatcttcaccaccacttgtgataaatttttaagtgtttcaattatttaaaaatttatttaatttagtagattcctaagcttgctgctattttacttgcgtcatatccttctttcaacttaacgtaagctttcttttccccttttggtgttattaatgtatttactttctcaacttcaacatcaaacaactctttcatagctctctttatatcctgctttgtagctctcctatcaacgtaaaatactaatttgttttcctcttcaatcattctaacagttttttctgtaactactggagcttttattacatcgaaggcatccatttttatccccttgtttctgcatttttattttatttattcaaatctctcttttaatttctctaatgcactttcagtccatacggttaatcttccagcaactcccccaggagctaaatggataattcccaaatctttagcagttataacatcaactcctggtaagtttcttgaagccaatatagcgttgcatttatctccaacaacaactaagatacttcttggttttttgtattttcttcctctcatcttaccttttccagctctaatcttaattccgttcttagctcttataacatcatcactgattcctaatttttcaaatactgcaaatacatcttttgttttttgcaactcttcaaatgaactttcaacaataattgggagattttcagtctcaaagacatgtcctctttctttaactaattcagggtttgctgtagctgcaatagcactctttattgctttaattctttcttttttatttactctttcccataatattttctcaacttttggtgggtgtgctcttcttccaccaactgcttgtggaactcttgcagcccatccttgtggaactctatctactcttgccctaccgtgtcctttaccaatgtttttagcacttgttcttaatcctgccaatgggtctgaaccttttggctgtaatcttgctgtaaatgcagataagaaagctctcttaattaaatctggtctgtattcttcttcaaatactgctggtaagtcaatttcttttactgcctctccatttaaattataaacaacagccttcattattattcaccttctctctcaattattttaaagtattttatttacttaccttgctttgatgttgtacttatgtatgtaatttcaggtactttgattaatggctcctgtggtcttatagctcttcttaatacaattaatctctttgcaggcccttgaactgaaccttttaatacaacatagttgtttcttataaccccgtagtgtaagaatccaccttttggtgtaatttcatccccattgtttccaatctttaatattctcttgttgtattcagttctttggtggtatcccatttgacctggcattggaacactccacataaccatctttggttgccatggaccaatagaaccaacgtgtcttcctactccttttcttgcgtgcttaccaaattgtattttaactccccatcttttaacttgtccttggaatcctttaccttttgtaactccaattgtatcgactaactctccttcttggaagacatctgtaatgtttaactgcttacctaaaatctctttagcgtagtttaatctttcttcaatatcttttcctccaattctaatttctaagatttctggttttttctttggaaggcatgttaattttggatttgtatgaacgagaactctaacatcttcaattttgtcttttaatgcttctaaatcttcaacggtctttctgtcttcttttttagggagtttaatttttctttctaattctttgtctaagttgtctgcccaaacttctgttaatgttgttaagtagtttctttcatttcttccataaactcttatagcacatacgttgattggtggagcttctaatattgtgattggagtaaatacctcctgtccagcatttggactttttggattatcttctttaataaatgcatggctcattcctgctttatatactggaaatgcctgtaaccttactgtatcctcttctggccagcttctaattcttggaactggtctttttgctctttttcttggactgaatgctaatgaacctcttcttggtctgttaatatttaaccccataatctaacctccagcatatttattgatatctttaaaatcttttatttgagtgttttgtttggtttaatatctaaatagcttttttatagtgtctttcaaaacttttgaaataactaaggtattaatgaacgccttaaaggcgttcaatgttccttaaattaattttattgattttggaagacactatattttgcaaacctgtcattgccctacccgggcttttcaggtttgcattatttgaggtataaattaataacggattagtgtaataaaagaaaaggagtgtataaacaaatactaacaatagggtatataaaatttttggtggtagcaatggatgagctaaattatctaataaactaccttgcaaataaagatagtgttagagaagaaattttaaagttatcaagggaaataacaagagattgtgcaatgttaattagaaaaattcacaaatcagacgataaagatgagtttaaagacaaattaaatgagatatcagaaaaaattaaaaaactaaatagtttagcaacattcccagagtttgttggatatttatctacccctcaacaggaatttgttgaggcattatctttgtatatgataaagtttgataataagattccaagtttcaaagagcttgattttattaaagaagagaactacatcttaggattagctgatgtgattggagagttgaggagagaggtattagaggcaatgaaaaatgataatttagcagaggttgaaaggtatttcaaatttatggaagatttatatgaatttttaatgaactttgattattatcacgtagtggataatttgagaaggaagcaggatattagtagaggaatcttagaaaaaacccatggagatattgttacttttattcaaaatcttaagcttagagaacatttaaaaagagttcaaataggactttcgcaggaataaatctctataaggaaaatgatgccttttaggcatctaaattccaaattcaatatataaactgcgaaagtcctattcaagagtaattattcaatagggaatcttaataaaccggctattcctcctaaggcttttaattgctttccagcatcatgttcagaggaaacgataactaccttcccacccatctcttcagtagtatctattattttttctatctcatgatttcttactaagctatctgaaactaataatgtgtctatagctgaatattctaaagctttttttacttcatcaataccataaacagccaatccctttttagcaatctcttccaaaagcttttctatcaattgtgtttcttttgcaacccttgattcagcatatattctattaataattcctcttttaataacctcatttaatccagctcttgaggttgttgatatgctctccacaactattttatttttaagctctgggtattgagaggaaataaaattataaaagctattttttgcaaatcctggccctgcgaccaaaatattatcaacatcatactctgacaaaaccttagctatttcatgataatactctttttttaactcttcgttaattttataatccaatttttttgaagtgtgagattttattgagcaaatttcttttatgctgtagtctctaacttcaaagatatctgcttcttcatcatccataacaacaactaaaaccttaggtcttttagatgattcaatagcttcctttattctctctatctgccattttttccaatttttttcaattgaaagctcatcaaatggtttaatttcaattgtatgatgactgccaaggggaacatcgtctgggccatgaattatagttcctaaaattctaactcttttcgtgttttcatcaaattctacgttttttacttcaattcctaaaaacatttttcttttggctcctctgtctgctctaataacgtctcctttatcctgcactcttctctcagtaactgcaaatatcttatctccttcttcaataatgttatataagacccataaatcatctaagttttcaggcataagcttaataatatttttctgtggaatttcttctataattttcatttagctccctccaacatctaagtccccattttcaaggatgtatattttaaatttctttttaactgttcttttttctataaattctgaagcattttcttttataagctcaatgagctctaaggtattgtatttcacttttataccttcttcatcagcttttttaaatacaatatctggaatttctaaaacatcagtcccttcttcaatttcaatagatagtggagccattatcctattataaatctttattgtgttatatgccttctttatattttcttttgcccttttttcaatcatacttatgttggctctacttgttccaagcatttttgctatttcttcttgggttaatcctttttttctcaattttaaaaccttaatttgtgtgtctgttaagaatgaatcctcaaccatgcataacaccaaataattattttggtggtaatttcttataattaacattatattaaacatttatataagctaccttatatagattatatttggtgaaattatggatttagaagaacaaaagaaagcagtaattgagaaattaattagggaggggtatataaaaagtaaaagagtaattgatgctctattaaaagttccaagggaggaatttcttccagagcatttaaaggaatatgcgtatgtagatactccattagagattggttatgggcagactatttcagccattcatatggttggaatgatgtgtgagcttttagatttaaagccaggaatgaaagttttagagattgggactggttgtggttatcacgcggcagtaactgctgagattgtgggggaggatggtttagttgttagtattgagagaattccagaattggctgaaaaagcagagagaactttaaggaaattgggatacgataacgttattgtaatagtgggagatggaactttagggtatgagccattagccccttatgataggatatatacaactgcagcaggtccaaaaatcccagaaccattaataaggcaattaaaagatgggggaaagttattaatgcctgttggtaggtatctacaaagattagttttagctgaaaagagaggagatgagataataataaaggactgtgggccagtggcatttgttcctttagttggtaaagaaggattccaagggtaaaatgataataagataaattattatctcttttattttattctgttttatttttgagtggatagttaatgacatattaactaagattaaaaatgagaaacaattttaattagagccaagataataaaatttcataatatatatttttatggtgaaataatgctttggagagatgtttgtgaaatatttaataaaattgaaaaaacaacaaaaaggttggaaaagagagattattttataaaattaattgacatggttaaagagaaagggaagccagaggatttaaaaaagatttgttatatggctatagggagggtttatcccgaatacgatgagagagagttaggaattggagaaaaacttttaataaatgctgttacatctataggaattaagaaagatgaattgttagagaaaattaaagagacgggagatattggattggcaatagagcaattaaaatcaaagattaagcaagcatctttattttttcagccattaactgtagatgaggtttatgaaaccttaaagagggttggggagatagagggagaaggttctcaaaagaaaaagttgaggttaataagtagtctctttttaagagcttcaccaatagagtgcaggtatttggcaaggttaattttggaagatatgaggatagggatgaatgttccaactatattagatgctttgtcagtttatttcaatgttccaaaggaaaaacttgagaagatatatgctataaccaatgatattgggcttttagctgagaaattattaatgggagatttagaaagtgaggagctaaaattaaaattatttagaccaataaaaccaatgttggctcaattaactccttcaattgaagaggcattattggagatgggcagagctcaatttgaaacaaagtatgatggagcaagagttcaaatacataaggatggaaataaagttaagatatatagcaggagattggaggatgttacaaatgcccttccagagattgttgaggcggtaaaaaatattaatgtagataaattaattgttgaaggggagtgtgtagctatagataaacaaacaggaaagccaagacctttccaagatatacttagaagatttaggagaaagtatgatattggaaagatgatgaaggaaataaatttgagagtttatttgtttgatattctttataaagatggagtatcatttatagatgaggaatttgaaaagagaagaaaagttttagaggaaattgttggttatgagaatgattggagaactgaaagaaagaggatagagaaagagcttaaatcagataaaataattgatatatcctataaattagtcacaaacgatgcaaaagaggcaagagaattttataactggtctctatctattgggcatgagggagttatgattaaaaatttaaaggctccttataccccaggaagtagagttagaacaatgtataaatttaaaccaactcttgagagtttagatgtcgtaattacaaaggcaaagagagggatggggaagagaaaggattggtatggttcatttgaaatatgtgttagagatgaggaagggaacctctaccctattggacatgtagggactggactaactgaggcagatttagagtttttgaaagaagagattgataaaattattattagagatttaggtgaagaggttgaagtagaaccaaagatagttattgaagttgcttatgaagaaattcaaaaatctgataaatatccttgtggctatgctttgagattcccaagggttgtaagatttagatttgataagggagttaatgagataaacactatagaggatgttgaaaggatatatgaaatccaaagaggaaggaaataatctttaatataaaaatctttgataaataattaaatttttcaattttatttttatagtggtaatttaaagaagaggtgatgtgaatatggaaatttttgggaacagcatatctaatatacttatttttgttgttataactctattgggtattttcattggaaaaattgtggataaaatagttagaaattatctcaaaaaaatcatagataaaacaaaaacaaaattcgatgatataatattagagtctattgatttaccaattattgtgttagtagttacattgtttttctattttgggttaagatttttaattctgccagattatatactcaagttgatagatgaagcagtaaaagttgtagttatcttatcggctacatattttgcagttaaatttattgatgggatatttgaacactacctaattccattaaccgaaaagacagaaacagagttggacgaacacataataaagccattgaaaaaagttgtaaagatattaacaatacttcttggtatattaacggctttaagctctgttggttatgatatcactgctttattggctggtttaggagtagggggtttagctttagctttggctatgcaagacaccataaaaaacttcattgctgggattttaatattgattgacaaaccctttagtttaggccattgggttaaagttaaaggggctgaagggattgtagaggagattggaataagaagcacacgaattagaacttttgattacactttaataactatcccaaactcagaattgttggattcagccattgaaaacttaacagttagagatagaagaagggttttaatgactatcggtttaacttataacacaccggtagagaaaattaagagggctaaggagataataaaagagattgttgaaaatcatccagctactctccctccatatagagtgcattttagggaatatggagattggagtttaaatttgagggtagaatactttgttagaaacatgggatttgattactatttaaatgccgttgatgaaataaatttgaagataaaagaggaatttgaaaaagaagggatagagatggcattcccaacatatactgtttatttggagaaagataactaagaggcatcatcgagcaaagcgagatgatgcatccatttttggtgaagcttttactgaaaggttcattgagagggcgttcccaacatatacggtttatttggaaaaggatgataattaaaatttttaaatcaagataattaatacatcctaaataatctcttaattttatctataaagctttctttccttattattttaatttcatcttcaatgtaaataggaactcctgctattattgaagctaacttcatataagcttgagaagctggagaattctttctatattcaataacactcatcttttttaaagctgctgacctaacattttcatcttcagggacttcaactaaaactttaccttttattaacatttcaatctcatctctacccatttcaccaaaatctctaccaaccctatttaacacaacacccattaaaggtgttccagccatttcagcactttcttttaatctaacagcgtcaataattgagaacatctctggggtgacaacaagtaaaagtttatcagcaatagctaaatgagtagccatttctctatttaacccagctggagcatctataattacataatcaaaatcatcagctacctcattaaccacatctggaagtaaatcaatatctgatttcttataaccttctaaagacaaactcgttggcaatacataaactccagttttatgtttgtaaattgcatccctaacatctgcctcttcactcaaaacttcatgtaaagagggttttttcttttccatattgaatagaatccctaaattagccattgatatgtctccatcaatagctaaaaccttttttcccaatttagcaagtgctactgctaaagatgctgatgttgtagtttttccaacccctcctttacccgaagctatagtaattatcataaatatcacaattaaactctattaatttatgtttatctatctttcataaaattatattttaaatttgtgacatacattataaatagtgttttttataattttagtgtcacactttttaataccttctttatgtgtgggaaaattttccaaagactttcacaaaaaatgaaaatgaccgaaaagtttaaataaaggattttataacagtatttattggaaatctattgtgaggtggtattatggctgagcttccagttgcaccatttgagagaatattgaaaaaggctggtgctgagagagttagcagagcagctgcagaatacttagcagaggctgttgaagagattgcattagaaattgcaaaagaagcagttgaattagctaagcacgcaaaaagaaaaacagtaaaagttgaggatataaaattggctttgaagaaataaattttatttttaaaatttttaatttttattattaatattttacttccttccaaaactttagaattcttttgttattttaatttatattcattaatttatatatttatttaaacggtggaaatatgcacaaaagaataaaaaatataaaatatgcggtagttactgtaagtgatagtagatataatgatttaattaagggaaaagaagtagatgataaatctggaaaattattaaaaaaagaactaaacgctaaagtatatacaataatccccgacaacaaaaatatgattaaaggaatagttgagcatatagttgaattttttgatgtagattgtattgttttcacaggaggaactggaatagctgagagagatgtcactgtagaagcattgaaagaaattattgaaaaagagttagatggctttaaaattatttttcaaaaactaagttatgaggaagttggattctcagccatgctatcaagagctatggctggaatttataaaggaaaaatcatatatgccctcccaggctcagtaaatgcatgtagaacagcattaaagataattaaagaagaaacaggacatatattaggacatttaagagagggataagatgaaatttttgttaatagcatcaaataaagatttagcaagtaaaaacatagctaatcatataaaagagtattttgatgtttttgaaactgataaggagcttttatctctaactgcagaagatttggagtatgcagattactatatatttttatcaaagcataaaagtattgcaaataaaccatccctaacagtccatacgcccggaaatttaactgaagataatacttttggaggaaatcctaaggaagtttgtccatgtgatgctgttttaaatactcttttattaaaaaacatttacaaaaattacaaaacatactatgaggatgggaagattggagagtttgatgtctcttttgaggtagttcatcactctccaaccggtttaaaagctccaacagtatttgttgaaattggaagtagtgaaaaagagtggattttaaaagaggctggagagataattgctaaatctgttttggaaacaatagatgcaatgaaatccaaaaattatgataaaaaagttagagctattggctttggtggagggcattatgctccaaaatttacaaaacttgctttagaggataaatattattttggctatttagttccaaaatatgcctcagtgtctgaggatgttttaaatcaacttatcagtaagatggaagtggataaagctcttattgattggaagggatgtaggggagatgataaaaggagatatattgaattttttgaaaataatggaatcgaatgggaaagagtttaaatgttttttctaaaagttttggagggaattgaatgggaaaaaatttaagagatttacttttagcatttaaaaatggagatataagcttagatgaaattgaaaaacagataaagcttaactattatgaagagattgaggaaagattaaagttggatataaacaggcagtttaggacaggagttccagaagttgtttatggtaagggaaaagatatagatgagataattaaagccacgctaaaacttgtagaaaaaaatggcatagcgttagcaactaaaatagaagatattgaaaaacttagtgacgaaattaggaagtggaatttaaaaaactacgacataaaaattaacaaaaaagcgaaaacattaataataaaaaataaaaactatgaagtaaaaaaaataggtaaagtgggtatattaacagcagggacctcagatattccagtggcagaggaggcaaaagacacattagaaataatgggagttgaagcaataactgcttatgatgtaggaattgcaggcattcacaggctgtttccagctttaaaaagaatgattgaggaagatgtttgctgtattattgttgttgctggtatggagggagctttaccttcagttatcgcctcaatggttgatattcctgttattggagttccaacatcgacatcttatgggataaaaataacgcctctgttaactatgttgcattcatgttctcctggaatagcggttgttaatattgataatggatttggagcaggtgtatttgcaggattgatagctaagataatgcataagtaataaagatagatgagggaaaatatgataaaagttgttgatggagagtatgtaaagacattatatgaaggaaatttagaagagataatcaatgagatagacactggatatattttaattttagttaaagaagggaataaattacatgagggttatatctttgttgaagatggaaaaattgttggatgctactacaccgatagtgaatctacagaggtttttggaaataaagaaaaagttattgaactgttaaactacgaaaacaaagttatagatatctacaaatataataaagataaaataaatttaatgaaatggctatatccagagatttttgcatgtaaagacacaaataaagtatctgaaaaaaatgaagatatgagtgagaagagagacatagttgaaaaatatctcaacataaaattggacataccattggataatttaatagaggcaaatacaaaggactttgaaaaatacttagaagataataaatatattattataaatgcttatagaaaaaaagatggcaaatttgagaacggttatataatatacaaaggacaaacaccaatagcagcggcttatgaatgtgacttaggagttttgttaggaaaagatgcctatgaaaaattggaagaaatgttgaaagatgaaaatacagttattgatgtctatgagtataatgagaaaaaaacacatgttatattagaactatacccacaaatgaaaattctggatgaaaacgaaaataaaagtagtgaaaaagcggatagtttagaaagtgaaggtagtataacaactgctgaagaaatagaagaagaatcaacagtctcaagagaagaactgctaaaaaaattgggaataaaagagccagatgagaattggatagagacaatattagaagatgtgtttagaccttcagatgaagaattggaagaactaaaagaaaaaattgagagtgagattgttaataaagttaagaggatggaaggtgttagtgatgttttagttaatcttaagattaagtgggagaatggtagatactatatatttggggatgttaatgtaaagagaaaaagaatcttgggaattatcaaaaaagatatagacccttcaattgttaaatttgagattgacaatacaattaaaaaatatgtatccaaatatacctcaaggataaatattaatatagagtaataaaataaaaagcaaatattcaaatagaagaaatgaagaggtattaacatggatgcgataataatttttttaattctttttatagttggggtcttgattggtgtaggagtgtattactataaagagaaagaaagaaagaaaacgtataagattattgaaatggaaattatcgaaaatcttaaagaattaaaaccttatgtagctccagatgaaggtagggaatatacaaaagaatttgatttggttgaaatagctctttcttatgatatagaagatattattgttgttaatgatgagggtttagttatagccactacattaaaggatgctgatgaagttggagctactgcatcgagcatatttgaatatattaaaaaactatgtggaaatataaaaaaggtcgttatatttaaggaagatagttatctatacatctatccattaaaactttatggtgaaaatctgtatgttataatagagtcaaaaatagcccttgacgttatagaagagaaagaaatactgaaaagaataacaggagttctcaaaaagtatttctcaacaattacaaccatagagcaagaaattccagaggaggcattattgagtatttaaaaattttataatttatattggcaatattgttcctctaacaggaacaaaggttggaatctttaatgtcttccaaatagtcatagcgaatgataatgattgatatctctccccatgcataactatagctttttctggtttaggaatcttctttatatatctaactaatgaattataatcaccatgagcagaaaattctattttaacaacttttccccttatagggattttatttttaaatggctgaatttctttagctccctcttctaattcccttcctaatgttccctctgcctgataaccagttaatataagcttgttttttgggtctttcaataactttaaatattttaataccggtcctccttgaaccatccctgaagttgaaacaataatacaaggctctttattaaatactaagctttcatctgccttctttatctcaccaaatggattaattctattctcaaccatattttttatttttggatttagccaatttatatagctcatataaacagcagttgcatgaattagggagccgtcagtatatattggcacatcccttaactttccacttctaatatagttgtttataatcaacaatatctcttgagctctaccaattgcaaaaactgggattattacttttcctccattttctattgtttcagatatttcctcaattaattgcctctctaaagtttttcttgctggctttatatccaatggagatccataagtagattctataattaggacatcaatctcatcgatatctgtatctgcagggagtaatgttcttgaaactccttcatttatgtccccagtatagagaatttttttcccatccacttccaagtatatggaagcacttcccaatatatgcccggcattgtaaaatttaaatttaatgttttcagttatttgcctttcctcatagtaatttaggcactcaatattttccatagcatgctgaatgtcttcttctttataagcttttgttaaatttagagtatctctccaagttataaacattaaatcagctgttggatgtgtgcaataaatctttttgaatttataaaatgggattgctccacaatggtcaagatgagcatgggaaacaataactgcatctactgctttatcatctaccttaggtatttctccagtgtctggagacattccgcaatccaataaaactctccctttttgtgtttctacctcaacacaactcatcccaatttgctggcaaccaccatgaaactttaataaaaccatactaccatcccaaaaatttatatatattttatttggataaatcctattacccaggcaaagaataggaaaccaaaaattaagttaagattaaaagaaaattttcatagtttttcgtaaagttgttaaatttagttatgaaaaattgaacaccctctatcgaaagacatttattatgtcctttatctttagaatatttgcaaaaaccaataatttagatgccaattaattaacaaaagaaaaattaagccttgtcatatcctatcaaaaatatgcaaatcaaaaatttcaggtatcataattattatatggtgagttctactaaatatctattttattatttttaaatcttactataaaaaggattggtgaatataatggaacataggcatgtcatctccgcgttagttttaaataaaccaggagtattgcagagaatttcagggttatttacaaggagagggtttaatatttcaagtattacagtcggaataacagagaatccacaaatttcaagagttacgatagttgttaatggagatgataagatattagagcaggttatcaaacaactcaacaaattaattgatgttataaaggttagtgagttagaggaaaagaaatccgttcagagagagctctgtttaataaagatttatgcaccaacagagagtgcaaaatcacaagttattcaatatacaagcatatttagaggaaatgttgtagatttaagtccagaatctttaattgtagagataactggtagtgaagataaaataaacgcatttattgacttagttaaaccattaggaattaaagaaatggcaagaactggaataactgccttagcaaggggaccaaaaatcttaaaaccaaaaagctaagttttaaaaagaccaaaataaggtggaaacatgaacgatgacgttaaaatgaagtgtggtttggaaatgcacgtgaaaatttaataaagtttcatcaaaactaacacctcctcgcttacgctcggaggtgtaaattaaaatttaatgggtggaaatatggaagatgttaaaatgaagtgtggtttggagatacatgttcaaattgatacaaaatcaaaattattctgtaactgctcaacgaattatttagatgcagagccaaacacgaatgtttgtcctgtctgtcttggattgcctggagcaaaaccactcccaccaaataaaaaggcagtggaagttgcaataatggttgcaaagatgcttggttgtaaaatagttgttgatgaagatatttacttccaaagaaagcattatgattatccagatttaccgagcggttatcagagaacttcaacccctattggagtagatggagagtttatgggtattggaatacatgaggttcatttagaggaagaccctgggcagtacaacccaagttttggaattgttgattataacagaagcggaaccccactaattgagattgttacaaagccagatataaaaagcccagaagaagcaagagaatttttaaagcaattgatgacattattcagataccttggctgtttaagaggagaaggaacaatgagggctgatgtaaatatttccattgaatatatgggagtccaaggaaatagggttgaggttaaaaacgtcaattcaattaaaggggtttataaagttctaaaatatgaactaatcagacagaaaaacattattaaaagagggggagaggttaaaagagaaacaagagcattcttagaaagtcagatgataactaaggcaatgagaagtaaagagactgctgaagattacagatatattccagacccagacattcagccaatagtcatctctgaaaaatgggttaaggaaatagaggaaaaaatgccagaaacaccattagctaagaagaaaagatttgttgaagagtatggtattgatgaagaggatgctaaggtattagtttctgacttagatatggctgaaatgtttgaggaagttgttaaatccttaggtgttaataaggaaaatgttgatttggcagttacatggattagaaatgagttgaggaggtctttacagtatcacaaagtagatttgtatgagagtggggttaaggcagagcatatagttgaattaataaagctaattaaagagggggttatatctcaaaaaatagctaaagagattgttgatttgttggttataaatagaggaaagaagatgcctaaagaactcgttgaggagcttggattaacagttattagagatgaagacgctttagttaaagcggttgaggaagctattaaaaacaatccaaaggcagttgaagattatctaaatggtaaaaaagaggcattgaacttcttaatggggcaagtaatgagattaacaaggggaagggcagatccaaagagagtcattgagttattgaaagagagattagataaataaatttttattattcttttttttaataattattttttaggtgataataatggcagaccttgataggaagttaatagaaattttagatattttatctaaatcaaaagagcctgtaggggctaaaattatagctaaagaacttaataagaggggttataaaattggagagagggctgtgagatatcatttaaagttattggatgggatgaaattaacaaaaaaagttggttatgctggaagggttataactgagagaggtttagaggagttggagaaagctaatatatcttatagactggggagtatttactcgaatatattggaaaaaacaatatctgccaactataggtttggatatgtagttatcaacagatgtcaggtttatgcagactttaatgatgtgttaaaaataataaaaagtgtctatgagtctggtttggctgttggggatagagttggaattatagatagggaaaaattcgtggaaataaataccctctgctcattaaactttgataatatcctactacaaaatggcatttttccactccatgtatgtgctggagttgttaaatatgaggatggaaaaccagtagaatttaaagaaattatagattacaaatctacatctatagacccattgagagcatttattgagaagaaagaaacagatgttatgggtattatagagaatggggagggttatttaccagcaaactttagatactttggagttgagtttttggagagatttgagactatattggagatagatgaattaaaatgtattattagttatgggacagaaaatgttttaggattagatgttggagatgataaggtgggagtcgctttaattggaggtctaacaccaatagctccatttgttgaaaacaactactgcgttgaaatttgtccaatgtcatcaattgttagattagaatctctccataagcttaaaaagaatccaagggatatagtaacaaagaaggcaaatataagaataaaaaccgctttatcaaaaatgttcaatgcaatggcaaaggtaacctatgatatagatgaagctgatggagatgttatagtaaatactgcatttatcgataaaaaataccttgatgaggcatttgatatactaaaagaggcatataaaaaaggtttaggcatatccgacagatttggaattgttgaagaaaatgataggataaaaattcaaacaatctgtgctgtaaccttagatggaatatttttaagaaactcagttcctctcataccaaaatatggggggattttggagataactgaagataaggagaggtttattgatataattggttatgatggttcgtcattagaccctcatgaagttttctttaattttgttgattgtgaaaaaacatttttggcaggatttagggaagtgcatagagttgcaagagagaaattagaagaagttttaaagaaattaaattggaatggtattaaagctataggagagccaaacaatgaactttatggtattggcgtgaataaagacatgtgtggagttgtaacaatggggggaataaatcccttagtgttattgaaagagaatgaaatacctattgagttaaaggcaatgcatgaagttgttagattttcagatttaaagagttataaggagatttaaactcatatatcctaaatactctcattaaagtggggctgaacgaagtgaagcccngctcgggtatcccaataggggcttcccctatggatttaaagagttataaaaatatttaaccacaattagtgatataaaggaactttaaactttttaagatttaaaagccatttttattgattcaactattgcctttattatataattatcatcaatcctttcagcatcccttgatgttaaatcaatccttaaacttttacttgccccaggcatacctgccacggttatagttataattccataattttttaacaaattaaacccaatctcaatgagttttttaatatttatagtgtcatctttataaactctttttattacaaatcccgttggtgttctttcataaacaatatttatattatcatctattgccttaagctctttgtttaatttttcaatcttagataaatcaaagtttttagccctttcaaatgcttttctaattctttctaagttaaagttttttaaagctctatatataccagccaataaagggggctgagcttctaagccaaacttagtgccttcaatatatatcttatcaacaagttccttttttccagctaataaacctcccctcggtccttccataagcttatctgtgcttgtaactaccaaatcagctcccaattttaatgctggaggttgattaaataacaacctaactctcgctccagaggcatcatcaacaaagacaatagcttctttatttttagctgtattaataacttttttaaagttttcaagttcaataactttcaaatccattgttgaaccagtgataataactagagtatctttatctattttatttaaaatctctcctactttatcagattcaaaatacttagcattaacaattttacaacttctctctattgatggatgtcctggaagttctggtagatagtggataactttttttggttttaatgccaatatagtggctaaaattgccgatgatgttctattaaaaccaacacatttatcattctcatctccacctaaatgtttaagcccatattcattaaccttctctgcaaagtaagatgacccaatgtaggtatttaataaagctttatctttttcatctattaaaaaccctcctgacaatccacttaagtcatacaatgcatctctacccttttcatttaatatttctaagataatttttcttgccttctctaatcttaaaaactcctcatagtcggagagcattaaatcaccaatacaagtttataaaaatttaaaaaatttaaaaaataaaaggaaaataataatgatttatccagccccacaagcatctcctaaatccaggtctattaattttccttcttctaattcttctttttctaatttcttaacgacttcatcaatatcttcttttctttctgttatcttcgacttatcgataactctcaataggtgcggtctatacattaaattgttatctaacacaacccaaatgtctccattttcgtcttttcttatatctacaactcttccttttgttccagtatttatataaaccacataatctccaactttaatattaacttcatccatgtatcccacgctccaaatattttataataggactttcgcaatttatatattgaatttggaacttagacacccagagggtgtcaatacgcaataaaaaatttattcctgcgaaagtcctattacaataatcttctctcatagcatgtattaataatttattcaaattattgttctattcctaaaaacgttgcatataacaacctctcgttataggatgcacttgagggatgcgtccccaatccggaggggttggggctgaggcaagcccacgactggtggtgaaaccccgcagcaaccagccgcaagaaaggtttatcctttcttgcgaccgtacctcccacttaattccggttgatcctgccggaggccactgctatcggggtccgactaagccatgcgagtcaaggggctcccttcggggagcaccggcgcacggctcagtaacacgtggctaacctaccctcgggtgggggataacctcgggaaactgaggctaatcccccataggggaggaggtctggaatgatccctccccgaaaggcgtaagctgcccgaggatggggctgcggcggattaggtagttggtggggtaacggcccaccaagcctacgatccgtacgggccctgagagggggagcccggagatggacactgagacacgggtccaggncctacggggcgcagcaggcgcgaaacctccgcaatgcgcgaaagcgcgacggggggaccccgagtgcccacgccctgcgtgggcttttccggagtgtaaacagctccgggaataagggctgggcaagtccggtgccagcagccgcggtaataccggcggcccaagtggtggccactgttattgggcctaaagcgtccgtagccggcccggtaagtctctgcttaaatctgcggctcaaccgcagggctggcagagatactgccgggcttgggaccgggagaggccgggggtaccccaggggtagcggtgaaatgcgttgatccctgggggaccacctgtggcgaaggcgcccggctggaacgggtccgacggtgagggacgaaggccaggggagcaaaccggattagatacccgggtagtcctggctgtaaactctgcggactaggtgtcgcgtcggcttcgggccgacgcggtgccgaagggaagccgttaagtccgccgcctggggagtacggtcgcaagactgaaacttaaaggaattggcgggggagcactacaacgggtggagcctgcggtttaattggattcaacgccgggcatcttaccaggggcgacggcaggatgaaggccaggttgacgaccttgccagacgcgccgagaggtggtgcatggccgtcgtcagctcgtaccgtgaggcgtcctgttaagtcaggtaacgagcgagacccgtgccccatgttgctacctcctcctccgggaggagggcactcatgggggaccgccggcgctaagccggaggaaggtgcgggcaacgacaggtccgcatgccccgaatcccctgggctacacgcgggctacaatggccgggacaatgggacgcgaccccgaaagggggagcgaatcccctaaacccggtcgtagtccggatcgagggctgtaactcgccctcgtgaagccggaatccgtagtaatcgcgcctcaccatggcgcggtgaatgcgtccctgctccttgcacacaccgcccgtcacgccacccgagttgagcccaagtgaggccctgtccgcaagggcagggtcgaacttgggttcagcgaggggggcgaagtcgtaacaaggtagccgtaggggaactgcggctggatcacctcctgagaaaaaagcgctggttgctgcggggcaccaaaccagtcgtgggcttgcctcatagggaaagtgggcccgtagctcagctgggagagcgccggccttgcaagccggaggccgtgggttcaaatcccaccgggtccactatatatgcagcctgcaactccaaagagttgcaggtgaagggcctgatacgggactttcgcaggaaataatttttatttggtaattgatgctttcagcatctcactaccttataaatattacaaactgcgaaagtcccgtaaaaacatgagggccatgcataggcttccacatcccggtgaaatctggatactctgccgggccaccagcccacctggtggatggctcggctcggggcgccgaggaagggcgtggcaagctgcgataagcccgggggaggcgcaggcagccgtggaacccgggatccccgaatgggacttcctgccccatttggggcgctcccgttagggagcgggaacgcggggaaaagaagcatccgagtacccgcaggaaaagaaaccaacagggatgccgggagtaggggcgaccgaaaccggcacagggcaaaccgaatccctacccgtaagggtagggagatgtggagttgcagggcccccaatacagacccccactgggaagccgaagtcccctggaatggggcgccatagagggtgaaagccccgtaggcgtaaccagttgggggtcttggggtgtccctgagtaccgcgcgttggatatcgcgcgggaagctgggagacattaggcttccaaccctaaatacgtcccgagaccgatagcgaactagtaccgtgagggaaagctgaaaagcaccccttgcggggggtgaaaagagcctgaaaccaggtgggtacggaatggcacggcccgaaaggtaaccaccccgaaggaaactcccgcgagggaggagtacgaggggtggcatgccggggtcgtgccgtccgtttcgaaaaacgggccggggagtgtacgggtgtggcgagcctaaggggttcaaccccggaggcgtagggaaaccgacatgcccgcagcccttatgggtgaggggcggggtcttaatgggcccggagtcacacccgtacgacccgaaaccgggcgatctaggccggggtagggtgaagcccctcgccagaggggtggaggcccgcaggggtgttaccgcgcaaagtgctcctctgaccccggtctaggggtgaaaagccaatcgagcccggagatagctggttccccccgaaataactcgcaggttagccgggggttaggtagatggcggggtagagccacggatagggtgtttagggggcgagagcctcggcaccctgtcaaactccgaacccgtcatcgccgtagcccccgagtgagggcatacgggtaagccgtatgtccgagaggggaacaacccggacccgggttaaggcccctaagtgccggctaagtgtaaatgagaagggagtccctggcctaagacagcggggaggttggcttagaagcagccatcctttaaagagtgcgtaacagctcacccgtcgaggtcaggggccccgaagataacgggggctaagccggccgccgagacccgggggggctgaaaagccatccggtaggggggcgtcccgcgggggtagaagctcggccgtgaggtcgggtggaccccgtgggaacgagaatcccggcagtagtaacagcaaagtggggtgagaatccccaccgccgaaggggccaggtttccacagcaacggtcgtcagctgtgggttagccggtcctaacccccggggtaattccctgggggggaaagggaagcgggttaatattcccgcgccaccggggtacgtgcggcaacgcaaggccagctcctgacgcttcggggtaggccgaccacccccgtcggggtggccaagcgcataagcccggggagtgccgtaatggcgagaaccgggcaaaagcgtgatgggccctccgttaggagggttcggctgagccctggagcccgtgaaaagggagctggcaaggatccccggtgaccgtacccagaaccgacacaggtgcccctaggcgagtatcctaaggcgtgtcgggagaatccggcccagggaagtcggcaaattggccccgtaacttcgggagaaggggtgcctgcggtcttctctaagtgaggggaccgcagtcgcagtggccaggggggtccgactgtttaataaaaacacaggtcttggctagcccgtaagggtgtgtaccaaggccgacgcctgcccagtgccggtacgtgaaacccgggtacaaccgggcgaagcgccggtaaacggcgggggtaactataaccctcttaaggtagcgaaattccttgtcgggtaagttccgacctgcatgaatggcgtaacgagacccccactgtcccgggccggaacccggtgaacctaccattccggtgcaaaggccggagacccccagtgggaagcgaagaccccgtggagctttactgcagcctgtcgttggggcatggccgtgggtgcacagcgtaggtgggagccgtcgaagccacccctccgggggtggtggaggcgcccatgggacaccacccacccatggccatgtccctaaccccgtaaagggggacaccggcaggtgggcagtttggctggggcggcacccccctgaaaaggcatcaggggggcccaaaggtcggctcaggcgggtcagaactccgccgtggagtgcaagggcaaaagccggcctgacttggtcggtaaaagaggccgaccaagaggcgaaagcsgggcctagcgaacccctgtgcctcaccgatgggggccagggataacagaaaagctaccccggggataacagagttgtcgcgggcaagagcccatatcgaccccgcggcttgctacatcgatgtcggttcttcccatcctgggcctgcagcagggcccaagggtggggctgttcgcccattaaaggggatcgtgagctgggtttaaaccgtcgtgagacaggttggttgctatctgctgggggtgttggccgcctgaggggaaggtggctctagtacgagaggaacgagccgccggcgcctctggtctaccggttgtccgacagggcattgccgggcagctacgcgctaagggataagggctgaaggcatctaagcccgaaaccctccccgaaaataggcggccagtccttcggggacgagggctctcctataagaggaggttgataggccgggggtgtaagcgccgagggctttgcccgaggcgttcagcccgccggtactaatcgcccaagggcccggcagggtatccagacactaagcggatgtggaagcctatgcatggcccaaaaaaaggaatggaaattcttgaatgggttatatgggtgtatagttattattttattttatcacattatatcaataaatttaaatatacaaataaaactgaaaataaaattttgtaaaagagataaaaattacttcttctttttcttcttcttttctggctcttcttttgtaataattattttttctgctttaattactgcattgtataagactatttttattcctggtggaagcccagcaaatgttcctggaagagtcatagttggtacttcaattccttcaacttcttccatctcttcttctacttcttcctcttcaattgcctcttcttcaacttcagcacctattctttcagcacatgggtgtcctttttcttttaggaacttgattaattcatcagttgttttaacgtcttcttctgtagctatcttatcatacaactcttctggtatcgcatctttaactctctcttttaactctttcggtaaccaaacaaccctctcccaaccaccgtctccctgtaagaacttaggggatttcatataagatattgaaataccaacgaacccaggaacctgctttccaccactacactgcccagctaaagtagagaatggaattcccattggagtttctcctttatatcccctatgtgctataccaaatccatcaacctctgggatgtagaagacaatagcctcaaagcatccgcaagatgtgcaaggtttttctaatgcactatgtagggttacctcttcaacagttccttgagacctttctctaacaacttcatttactccagagtaaattcctaacttttcatccaagcattctcctttaggtatttcaaatatcggtccgttagggtctattttagcagcagcccttgcatctaagtagtttatacctccacacaacgctggtctgtctggagttataacacacacgtgtgttggagcgaaactttgacacatcacacaaccatagaatacatcaacatcctcttcatgcagtgccttagttttctcatctcttttgttgtaaatttctcttgccttttctaactcttctttaactttttctgggtctgttatgatggttacatcacatttttctataaacggaaactctgccttaaacaatctttgaacgacttttccaatatgctttaatctcaatcccttattaaaagaatccttatttattcttatccatacttggtctctttggtttaggtgcattactccttctatgtaatttaaaaactcatggattcttctttctaaaactccttctaaatcttcctccaaattacttccactaacttcaacaattatagcgaatgggtttctactaccctcttccatctcatcaatatcttttcctataatttcaaccttatcctctgctttatttacaacttttaccaactcaaaaccataactcttcggccctgcaagttcaacatacatatcagggcccctaactctctccccctcattcatcggcccaacagagacagggatatcatcaaacatgctttctcacctttaagtgtttttataggttttctttagcttcttctctcaaaattttaagtattttttttcttttctcttctttcatcatgtcaagtgtttcttctgatactaataagagggctttgtccttacaagcctctacacaggctggagttattctatcaacatccaagcagagggtgcatttatgagcaaccctgttttttataaatattgctcctattgggcaggcaattgcacacattccacaagcaatacatctctccttatctacaattggaatgccatcttttagatagattgcatcaacaggacaaatctctttacagggagcgttttcacactgcatgcaaaatattggaatgccatcaaccttccttactctactctctccatgaatctctttacagatgtttatacagtcatagcatttggtgcatttttctggatttaagacgataatttttgggttcattctacccctccaataacttcctcaaatagtctaaatattcttccttgctgagatttgggaatgaataaagggtatttggctgataatatttgtctattgatattgttaccacatttgagaactgttttagatgagttgctgcctgagctaagtaatagtaagttattccagtgaatagggctaaatcataatcactacttgccaaatatttcattatagccattaaattcatttcttccggtgtttttattgtttttaagttaaatttctcaattaatttgctgattagctctttctcattttcctccaaattctctcccaatattaagattggttttttagcccttctaatcatcatcttaacaagtgttggagatgttatttcagcatgtgctacattgctcccagctgttgggatataggcaataaatctctcatccattactatcaccaacttcagaaatttaaagtaaaagaattaggagttaatacaatattgttgggtcttgtggatatttctccaatggcttccatcctttttcttctaagtatgccattatcttatctttcatcataaatgggatgtctttttcagttctaacgaatttctctaaatctggaggcattcttccaaagtatttttcatagacatcaacgtagtggtaaatcttattggctctaccttttggagtatcgtttggcctcatacatagctttggaatcatgcagatgcattctttaacattctcagcagttacaatcaaatgctctggagctggctctatctccaaaatttctcctgtttttttatctttaactttgaatttctctccattgcttaaatacagccttctatacttagctccatgagggcctaaaataacagggattccccatctattgactccagtagcaattgcagcagccttttgactcatagcaccccatgcaacaccaacagctccaactttgtttagtatgtaatctgcaacttcagcatagtttcctctcaacggaactttggcaaagatgttggcaatttttatagcagctccagtaatgtggcagtttgagagacaagaaccacaatttacaagacctccagccctaaattcacctggatacttctcatataatgtttttccatctttatctttccacattccaattgccattgctgcacaaccagttgctacaactatatacttcctctccaagaactcctttgcaatcatcgctacttcttcctcaccatttggatggtttgaacatccaactaaagcaacaactccaggaatatctccaaatacaattggagctccaacacttctaatttcaacatcttttataggccctcttccagccctcatcttgaactttaagtctttatagtatgcctctccaacctttgtagtcatgctaactattggcaaattccttggacagatagcttcacatcttccacagccataacatctcttatacaaatcaatgaatcctttaaaattaccctgttttgctaaagccattgcttccttaactttaaatgcatttggacagtttctgttgcaccatccacattcagtgcattgttttgccaactcaacaacttcatttaaatctggtagggtttttctatcctttctctccttagcaactattttagcaacttcaacagcaacttttccaactttcttctcatctaagagtaaagctgccctatttctcaataaatagcctataatttcatcctcatccatgtgggaaacatcctctaatcccaaacacatcttctcatttgttgctatcaagacagctccagtttttaaaacctcctctaagatatctgttctaatacactgctcatctacaattacaacatcagcaaccccacttcttacaaacatcaactgccttgataaaggccctacaacctttggtttatctgaaacccttgtgatgtctatagctgtacaacagataccgcagacctctacttcatcctccatactgttttcttctaaatactctaatatgtagctacctgggactacgttatgcccaatacacaagataactggcttactcttgtctatgcaaccaaaccctaattctattaaaggagcatcttcatctccttttggcatgttgtaggcaactatttgggccaaatctcctgcttctcttgctaaatcatcaatcattcctgcatgtaacgctttactctcaaaatctaagtaatccccttcctgcccagtatgtgccgctgataataaatgagttatctgctcttcacagtaatctaagattttctctaaatctccaagtgtttttggtttaataccagttactgtccttgctattggtgcctcaacctctatttcattacccaaatctattggataatctcttcccaacgtctcaattaggtgatgaactaaatgcctactatgtccagcatgacatgccgctccaatacagcaggcaattaaaacaattcttgcctgttgagctttgatatttaaaccacaagctcctttcttccctctgcttaaatcacactttccaaaagtacagagacagcataaatcacagattggcatatagaatggaggatatctctctaagagcttaaagtcccagtgtcttaatgtagggatttttggcattggagtaggtcccattggttcccattcttcttcctcttcttctccaaactttatactcatggatatgtttgcgtttttcatcttaactaatggtgtaaggagttttttaatgtccatttctacgttattccccataaccatcacttcttaattgtcatgattaatcattataatttaaggttagtttttaaaactttaatatataaagtttgttatgactaaagccaagtttggtatgaaaataaggactgaatttttcttttaacaaaaaaattacgcattttaaaaattgttttgtagggatttttaaaaatgagtatctattaatttaaaaaaataaattagtgttggcataaaatataaagtttatgatagggcatttatcttttcacattgagatttatcacaatcttgacgttcttcataataatttggattcctccctcttttgctaacttggttattaactcaccaacttcaatgccttctttttcctcttcagtagctttaacctcttctttctcttcttcgacttcttcaacaacttcttcctctgtctttttaactattggatgtcctttttcttttaggaacttgattaattcatcagttgttttaacgtcttcttctgtagctatcttatcatacaactcttctggtatcgcatctttaactctctcttttaactctttcggtaaccaaacaaccctctcccaaccaccgtctccctgtaagaacttaggggatttcatataagatattgaaataccaacgaacccaggaacctgctttccaccactacactgcccagctaaagtagagaatggcaaaccaaacggtgtctctcctctaaagtttctatgggctactccaaatccatcaacttctgggatgtagaagacaatagcctcaaagcatccgcaagatgtgcatgggtttgttaaagcactatgtaatgccatctcttcaacacttccttgagacctctccctaacaacctcattcacacctgtgtagattcctaacttttcatctaagcattctccttttggtatttcgaatatcggtccgttagggtctattttagcagcagcccttgcatctaagtagtttatacttccacagagggaaggtctgtctggtgttataatacatacatgagttggagcaaaactctgacacattacacagccgtagaatacatcaacatcttcctctcttatggattttgttttttcatctctctttttgtaaatctctttggctttctctaactcttctttaaccttatctgggtctgttataataattacattacacttctcaacaattgggaaatgttctttaaagagttgttttacaacttcaccaatgtgttttagtcttaaacctttgttaaacgagtttttatttattcttatccatacttggtctctttggtttaggtgcattactccttctatgtaatttaaaaactcatggattcttctttctaaaactccttctaaatcttcctccaaattacttccactaacttcaacaattatagcgaatgggtttctactaccctcttccatctcatcaatatcttttcctataatttcaaccttatcctctgctttatttacaacttttaccaactcaaaaccataactcttcggccctgcaagttcaacatacatatcagggcccctaactctctccccctcattcatcggcccaacagagacagggatgtcaaattcaactaccttaaccttaacgcctttcatttttagggcattttctactatattatcaatgtctgaactctctaaagctcctttaataactggaacctcattgttggttataactgggactccagcttttatacatccagctccagcggctaaggttatgttatccaactctcccaaagctacaacaacagctggaactctgttttttagatagtctataatttcttctgtttttccaggctcaattcctccaaatattaatggagctcttatagccaagtttgcagcgtgtattgctgaggttatttcatttccaactggaacaaggagtttgtctaaaccatactcaatgtcagcttcatccatctctttaactatatctccaactaataacgccaaaatatttctcttttttatgtcatctatgagtttttttagcttctctttatctccaacttttccaataactactaaaattgcagggatttttccttctacgagaggaactcctaaacctctcaaaatttcatcaggaataaagccaacatatggctctttgtaaggtttttcactctttgcatattttaaagcctcaatcgcttcagcacatattaatgttacaactccagcatctaacgcattttctaacgtttcttcatcttttatctcaagtgagttaattaattcttttaagtctttgactgtctctatctttttacctaaaagaccgtatataattggtaggttgtaatttgttccaggataagatacttttaggttctcatcttctttctctaagatttcttttgttaaatttagaactgttttccctccttctattatattgcccacgaccatcgtttcaccatataaacgaattttcaaatattcgaatttaccatatacagtagtctaattttaagtttatgcattactatataatagtggttacgcattgcgaaaaatttaatacaaataacttattaaagattttaatatccatggtaaaaatagcacaaacctaagcattaattaaaaatttctatgacttgcaaaataaaaaatagggcttttttaaatgtttctatttgatttttttagtaatatctgatttttttgtttattatttagtaataaaattttatattggcatcttactaccatctttaaatgttctcaaaacaagagttactttacatccattaacattaactaatggatatatcttctctgctaaaaattttcctaagctttctatatcctttaaaattgctatacaaacggcatcatattctccagtagtttgatagagttcaactatttcatcaagctcttttaatttattgagggtttcttcaaccttagatggtttaatatataaacctaatatggcaactacttcaaatcccaaattttttggatttatagatgcatgaaaacctgttatgattcctttttcagttaatctttttactctattccttacagtcccctcactaatacccaattctctcccaatttctctaaatgattttctggcatttccatttaaaattcttagaatttttaaatcaattctatcaagcatttaatcaccaatacaatttatcttcaatttttactaaaaattcgcagtactcatcaccctttccacaacattttgtttcaacagcattgacttttcttcttagctttttttccaaagttccagctattagtccagcctcaaaatgacagagggtagttccaacatttggaacattatggcaagatatgcagtcttttaaaattagaatcatctcattttcttcaactttttttacttctaaaatgccaatttttgccttctttaatatttctgcaaagctttcgagtaaattgtccctatcgacgtatcttgaaattacttctctaccaatatcttttccaatattgtaaattattgcttcaatgccacatccagcagttaaaactcctattcttactgcttgaaatatagataagggtattaaattccctaacgttctttctggaggatggttgtttattaaatcctcaatatcttttttaatttttttatgtaaaagctctttatccattttaacatcccccatacagtcaaagatttatataacaaatgtaggattattcattaataaagcttgtttattctgataccatgcttagagatatcgcatttgaattttttataatgattgccttgggtatttttattggttatatcatagcagaatacacagataacaatttatggatagttgtatttttgttattaggcattttttgtgcatttggaaggttatttaaaatgattaaagattatgaaaaaaggtgattttattggaaaaaacacaggaaaaaaagataaatgacaaagaggagcttatagttaaggaagaggttgaaacaaattgggattatggctgcaacccttatgaaagaaagatagaggatttgataaagtacggtgttgttgtagttgataaaccaagaggtccaacgtctcatgaggtttcaacatgggttaaaaagattttaaatttagataaagctggacatggtgggacattagacccaaaggttactggtgttttgccagtggctttagagagagctacaaaaacaataccaatgtggcacattccacctaaggagtatgtttgtttgatgcatctacatagagatgcgtctgaagaagatatattgagagtttttaaagaatttactggaaggatttatcagagacctccattaaaagcagctgttaaaagaagattgagaattaggaagattcatgaattagagttattagacaaagatggtaaggatgttttatttagggttaaatgtcaatctgggacttatataaggaaattgtgtgaagatattggggaagcgttaggaacatctgcccacatgcaagagctaagaaggactaaaagtggatgttttgaggagaaggatgctgtttatttacaagatttgcttgatgcttatgtattttggaaggaggatggggatgaagaagagttaaggagagttataaagccaatggagtatgggttaaggcatttgaagaaggttgttgttaaggatagtgctgttgatgctatctgccatggagcagatgtctatgttagaggaatagctaagttgagtaaaggcattggtaaaggagagactgtcttagttgagactttgaaaggggaagctgtagctgtaggaaaggctttaatgaacacaaaagagattttaaatgcagataaaggagttgctgttgatgttgagagagtttatatggatagagggacttatccaaggatgtggaagaggaagaagtaaattgaaatggtgattcaaatgaaattcttcaatagagaaaaagaaattcatgaaattctatcaatcttagagggagaaccaaatataatttatttcatctacggccctttaaattctggtaaaactgctctaataaaacacatcattgaaaacaaactaagtgatgattataaggttttttatattaattttaggacttatttaatttcagaaaagagggaatttattgaagctatctttaccactaaaaaagatgatttctttgaaaaaataaaagataaatcagaagttttaaatttgataacaaaaggggctaagattttaactggtattccaatacctgaagtagagtttgataaattatttgaagagaaaataaatgatgccttccaatacttaaactctatactattagaggttaaaaagagtggaaaacagccagtgttaatacttgatgaacttcagatgattaaagatgtagttttaaattggcaaaaatacttgttaaaagagttgtttcagtttttagtttctttaactaaagaacaacatctatgccatgttttttgtctaagttctgatagcttatttattgaatatgtttatagtgctggagagttggaaggtagagccaaatacctcttagtggatgactttgataaagagacagctttaaaatttatggatttcttggctaaagagattttaaataaaaaactctctgatgaagataaagagttaatctataactatgtaggaggaaaaccggtatatatctacagtgtgattgatgagatgaggtataggaagttagaagatattctaaatttaatgcttaaagaagaaactcaaaaactaaagtattttttaaaggagttggattatataaaaccaaaagtagaacttaaagatgaaatcattgagattaaaaaggatgatattataaatgcgttaaaattatttaaagaaaattatgaagttagtgatgatgatataccagaaccagtttatatttatttagttaagaaaaatattttattcctaaatcctattgaaggaattttaaaaccacaatcatttttaatctggaatgctataaagaaattactgaatggacattaattggggctgaaagccccaacttataaccaattatcaaaggatattatttactatggaatttagaagcccaaagggcttctatatgtgccttatttaattaaaaactttgataattggttaaatggacgagttttgatgaaaccgaagcgttagcttcgggctacaaaaactcgaagagtttttgttcaacttttactaaaagtttcttttaaaaccacagagttttttaatctggaatgctataaaaagagtgttataacacatcaaaaactacttggagggataataatgaagatagaaataaatgaaaacttctgtaagggatgtgatatatgtattgtagtatgtccaagaggagtatttgagaaatcaaaaaagttgaataaaaaaggtatctacccaccaatcccagtaaatcctgaaaaatgcacaaagtgcaatctctgtatattacaatgcccagaccaagctatatcaatagaactttcgcaggaataaaatttattattgcacaaagatgccttttggcatcaatgttccttaattagtagtataaaactgcgaaagttctattcaatagaagagtaattaatttttttaatacctactacataaactttttaatggataataataaataaaaccatactgaagttaattatttactatactacatactttataaattagtggaagagatgggaaaatgattcaaataacagtaattcagatagataattacggaccttggacagttacaccaaatccaagaagagagagcgatttacaagctctgcagagcagattatacgctgacttaaatttgatgtttggggctcataagggactggtgttttacacaagatttgataatttaatagctataacaaatggtattgatttaattacacacaaaagaattcaggagagtataaggaatagatatcctttcactgttagtatggttattgcttcagctgaaacaccttatgaagctcaaaaattagccactgaaacacttcaagrgtatggaagtgctcaggatgagaatagaaaggaagttttagatgttgccaatgaattggttgttgatggctatgttcaaatcgctcatatagatataaacaacattactgggactcttactgacattgtgagtgcctatgacacttatttaaatgtgaataaggttaaattggctttaatggaagagcttttaaaatataacgctctgttgtttttcataggtggagataacttcatggctccatcaaacggaatgagtgaagaagatttcttagatattttcaacagaatcaataaaaagtataagattgagctaaaagcaggaattggaataggaagaactgctgaagatgcctcaaacttagcagatattggtttagaaaaaattagaggaaagttagttgataagaatgtatgcactttaaagcaggatgacttcttagaatcaaaaatgggtatgggaaaaatataccatccacagttttaggtgattttatagatgaacaaaaaaatagaagaattaaataaattagataaaaaagttgtcttagcaccaatggcaggcattacggatggggatttctgcagaaaatttaaggatttgtttgccattgttaccattggtggctacaacttagattctgcaacctataaagcaagtagagatatagagaaaaggggaaggaaagaattttctataaatttagaagaatttaatagctatataattgagcaaataaaaaaggcaagagaaagtaatgccttagtttcagttaatgttagatttgttgatatagatgaagcttatgacaaactattgactattgccaaacatgctgatatcattgaacttaactgccattgcagacagccagagataacttctttaggtatagggcaagagctaatgaaaaataaaaatcttttaaaagaatttttaactaaaatgaaagagttaaataaaccaatttttttaaagataagattaaattgcatcccactaaaagagctaatagataatttaaactatgtgagagattattttgatggattacatgttgattgcttttatccaggaaaaccttatgcagatatggattcattaaaaattttggcagaagaatttaacgataagataataattggaaataactcaattgattcaatagaaaaagctaaggaaatgttaaaatactctgattttgtatctgttgcaaggactattttaaaaggtaatgttgaatggataaaagagttaaataaagagaatatttaatttttatttttattgccaagttttttaaattctttggctaaacactcaaaaacttctttatcttccacattctcaaatatctttattatatcgtaaattattctcttacacaatgcctttgaaaaatcttctaaaacttcctcaactggcttatttttattcttcaatatcttttttgctttttcaacctccttctttctcacattttcaatatattgcccaagttcttttattgctgtttcaaatctcattttatcaagaaattcttttaacctctctaattcttcacaaataatcatctcaacctttgggatttcttcttttctcttctttaaattttcttcagccactaatcttaaatcatcaattgtgaataaaaaaatatctggcagttctctaatgtcatcagttgtgtctcttggattggcaatatctataataattgtctttccagcattttttaacctctccttatttaaaattggatgtggagcccctgttgctgatataactatatcggcatatcttaaagcctcttccaatttatcaaactttatagccattcctccaagttctttagctaatttttcagctttttcataagtcctatttgctacgataattgctttaatgtttttttccttcaatgcctttataactaaatttgccatctctccagctccaattaataagacatttttcccttctaatccaaaaattttttctgccaattcaactgccgcagagccaattgaaaccccgccctcatttatctttgtctctactcttgccctttgtccagtatgtattgcctttaaaataattttctccaattttttggatattctgcctttttcttttgcttttagataggcattttttaactgcccaagtatttggtcttctccaacaatcatggactctaaaccacatgcaactctaaaaagatgttctattgctttatctccaaatagaatatcaaatttttctaaatctatattttcgattcctttaatttcttctaagctatctgcatcaaagattatctcaactctgttgcatgtttgtaataatatggcattatcaaatgtctcataaaatttttcttcatccattctgagcttttctaattcagagacgttgtattttttataatcagcttttagtattatcattctctccctttagtatattttttgatattaagtattttttagttttatttaagaatatatgccctttgtgaagtaaatattcagcctcttccttttttatttcaatggttgcgtcataatcagctgtttgcctataattgtatgcttcatttatatattcaaataattcaacatctaactcattagtttttataaattcctttgcaaacatttttaaaactccactgtgttttttaggattaatttcttttgttaataataaagccttaacacaataaaacattgagtagtatattcttgaaacagcaaaatcataaaattcgctattataaagattttctgatgcttctaatgatttttctgctttttctattaatttttcaagctctcttttatacctcaactccataattttcaacctcatcaataaaagacgtttttatagtttttttgtaaattattgggctaattagaatatcatattttaatgagtatcttgaggcaattttaataattttttgtttttctttaagagtaggcatttctttaactaaaattaaaacatcaacatcgctctcttcatcataatctcctcttgcataacttccaaataaaataactctgtctaatttatcttttaaaatggttgatatatcctttttaaactcctttataatttcaatgatttccattttcccacttctctattaatttttttaattcttctctaaatttttcattttcaaaaatcttttttaatattttttccctatctttctgtttaggaattgtctcttttaaaaactctcttatataggctatcatatttatgtcagttgattttagatagttttcaacaaaaattcttatatgcttagctattaaaggactttttccttttgtgtatatgctgaatattacttcatcaacctctgtataagcagggatgataaaattaactccttctgtctttgttgaagaatttacaaatttgtttagctctttagctaatttaacaattctcttattaatttcatcgttgatagctgttactataaaatcatacttcattataatattttttagctcttcatcacttaactgattaatatcaatttcaattaaatttagatttttattgctttcttttaatttttttatttcttcatcaaattctttagagtatatatcaacaatccctccactttttaatattttcttagctctcctttttcctacacttccacaaccaaatactgccactttctttccttcaaaagataacaaaataggaagcaaattatccctcccatagttagaaagtatttattagatatagtgaatattatattagagttagaacaagtgaattttaaaacttattatagggactgtcaagttaagtttttattaaatattgataaaaaataataaactatgaggctcacgatagaagttataaaggagagaatcgtagagaggaagctttttaaaaggaataggaaatcgatagaggttaaaatcttagcagggcttttatactacctcgggttatcgttaaggaaggtaagtttattcctttcccaattcgaagacataagccacgaatcggttagaatttattatcacaagattaaagaggttttaaatagatttccaagtaatagtaaattcgatacggttgttagttggataaaaagcttcatgatgttctataattgggtgaaatcactaacttgacaatctcttacaataccataaaaattttatattcaaacatcagttaaaacttattagatgggctcgtggtctagtggctatgacgccgccctcacaaggcggtggtcgcgggttcgaatcccgccgagcccaccaataattttagacctttttctgaatacccattccattttgatgaaactttttctaaaagtttcatttgtatctcccgagccccattttctatttttagtttattctactccctcaacatatctttttaacttctcaagctgttctttagtcccaaaggcataaatgatgtctccaatattaattactgtgtcaggaggaggacttgtaattgttttatctccttttttaactgctaaaattgtggctccagttttttccctaatgccagaatcctttaaaagtttgttatcaagttctttattttttacaatgtatcttctaacttccatatcctcttctgtagccactaaggaatggataaattcaacaatatcgggatttatagctattcttgcaatttccattcctccaactatataggggcaaaccgccctatcagctcctgcttttattagtttatccaacgttgatggcttttctgcttttgcgactatgtagatgtttggatttaacttttttgctgataaggttatgaaaacgttttcagcatctgatgaaactactgaaatcaatcctttagctttttcaatctttgccttttttaaaatatcgtctgatgttgcatctccaacaatgcagataagatttgggtctttctcaagagcttcttctaataatttttcatctgaatcaatgataacaaatggaatattacattttttaaactcttcagctattacttttcctaatcttccataaccgcagatgatataatggttatttagttttttaattctgtccatcatctttctcaacctgaagtattttctaaaatgcccttcaatgaaaaaacttgcaatgtttcccatagtatatgcaactgctccaacacctgcaaatatgtaaattataactgaaagttttccaagaaatgtttgtggagtgtaatctccataaccaactgttgatattgtaacaacagcagtataaaaggctgtgaaaaagtcccagccttcaactgtcattaatattactgattcaattaagatgagtaagatgataactattataccaagctctatcttctcataagtttccatttaatctccctttaatgccttttgtaaagaggttattaaaccagatataaagaataggactgagaatattattattagcttcccagcatctgtttttggtgttatatctccataaccaaccgttgttattgatattgttgtgaaataaaaagcatcaaagaaattgtttattgctggatttacacctgattcgacaatccatattaagcaggaagcaataaagcaaattgttaataatgttagaaagtttattaatgcctgattttcttctaactttcttaacttaattattctaagtaaaactaaaattcttagtaggtttataaccctaagtcctaagaatgcctttgaataaaatacctgtaaagaatacagtaagaaagcaataacaactatggcatcaacaatattgtaaatgtctttaaaaaactttgccttgtcttcaacataataaaaattgtatataaactcaaatgtaaagaacataatagagatataatctaactttattagtaagtcttgatacggtggattatatgttgagagaatgaaagaagcgactatctcaaatgtaaaaattaaactcaatacttccattattttctttaaccgcctatcttttaagttcatttatatcccaatttgaaatttttataacaaatatttttggtgatatccaatggaaattggtattttggatattaaggggtctcttccattatttgaagatttcggcaatctaccaacaaagattataactgaaaataattataaagaaattaaagatttagatgctttgataatacctggaggaagtttaattgaaagtaaatcattaaatgatgatttaaaaaaagaaataattaactttaatgggtatataattggcatttgcagtggttttcagatattagctaaaaagatagacattggaagaaaaagcagcgttccaataattaaagagggcttaggtttgttggatgttgagttttctccattagtttgcacagatagagtagaatttgaagtaaaaaaatcaatatttggagagggaaagggagaagggtttcactgccatacttatggaaatattgaggtagttgataaagaaactaaaattctaacagtttcaaaagtaaaaaagctaaattataaacttggagctgaaaaagaaattatctctggagcttttaaaggaaaagtgtttggaacaatggttcataacttcttagataatgaatttgtcagagacaattttttaaaacatttgggagttacagaggatgagaaagaggaaatatttgaaaaaaataagattataaaagatgaattaaaaaagagggctttaaaatatagattaaacccaaaattactaaaagagaataataaaaaagatgttaataaaaaaagagggattattttattggcaacatcatcaaacagtggaaagacgtttttaacaactgctttatcatcaaaattaaatggaagagtttttgttgctaagattggcggggatgttagggatatagtgccagctctttatttattgagagagaagatgacaaaatacaacagcataaagattggagagagaggatgggttgatgtttctaaatttttagattatataaaaaagtcagattatgattacataattgttgaaggggttatgggagcttttactgcagcattaaaaaatatttcctcttatcaaatagccaaaaagcttggatttccagtttatatagtaagtgcttgcaatataagtgggatagagggagcttttgtagaggcaatggcttattacagcctactcaaagatattgggattaaagttgaaggagtaattttaaataaagtctatgattggaactctttcaataaattaaaaagtttggctgaaaaacataacataaagctctatggagttggaaaaatagctaatgagagtaggggactaattccagaagtagagattgattatgaaagcttctgcagaaatgcctttaatgttgatttagaaatagaaatcccagaggttgaaataaataatcatataaaggatgaggaagataactttttagagaggttagataattggatggaaaatattaataaatattaatttaagaggcattgccgagcgtaagcgaggcaatgcatcccgggtataccaatagggcgatagccctatggggagataactttttagagaggttagataattggatgagaaagataatctaaaagaactttcattttatttatgtggggggagaaaatggacccattaagtggttttattagctcattaatttggtggcttttgttcttttatttaattatggctcctcaaatacagtataagcaattacaacttgcaagattaaaaatacttagagagctatcaaataaaagaaattcaacagtaataactatgatacataggcaggagagtattggcttgtttggaattccagtttataaatttataacaattgaagatagtgaggagattttgagggccataagggcagctccaaaagataaacctatagatttaattatacacacaccaggaggtttagtcttggcagctactcaaatagcaaaggcattaaaagctcatccagcagagacgagagttatagttccacactatgcaatgagtggaggaactttaatagctttagctgcagataaaataatcatggatgaaaatgcagttttgggacctgtagacccacaacttgggcaatatcctgctccaagtatagttaaagctgtagagcagaaaggggctgataaagcagacgaccaaacattaatattggcagatattgctaaaaaagcaataaatcaagttcaaaattttgtatataatttattgaaggataagtatggagaagaaaaagccaaagaattgtctaagatattaacagaaggaagatggactcatgactatccaataactgttgaagaagctaaagaacttggtttagatgtagatacgaatgttcctgaagaggtttatacattaatggaattgtataagcaaccagtaagacaaaggggaacagttgaatttatgccatatccagtaaaacaggagaatggggctaaatagaataattaattacattatacttttttatgttgcaattatcattaaatctaaataactctatttttacagatttctatcctattaataagacaatataaaaaaagctaagggattttcacattccgaatcggtctgattttaatggagcggggttcatctaaaaccataagcgggttaaattagataaagtttccattccgaaacggtctgattttaatctgattttaatgtctcattatcaaatattacaactggaattaatacaatttccattccgaatcggtctgattttaataaatatcaaattgataagtttattgaaggtggtgttttgtttccattccgaaacggtctgattttaatcataaacagtatataaataatataaattctgtaatgcgtttccattccgaaacggtctgattttaattaaaaatcatccactattaaaacaatatgttgttttgctccatgtttccattccgaaacggtctgattttaattactgttttatagttaatttaaatgaaaatgaagcaaaaagtttccattccgaaacggtctgattttaattaccacattatacacaatagatttaaacaacaaaaataatttccattccgaaacggtctgattttaattgatgagattatagaaaatatcgcaaaagataaaaatacttcatttccattccgaaacggtctgattttaatggaatgaaggtgttttgtgctttaagttttaactactgatttccattccgaaacggtctgattttaattccttatttgcaacgttatatttttaaatttacattatttccattccgaaacggtctgattttaatttaaagcaatagaagaagctatagagatgaaattaaagacatttccattccgaaacggtctgattttaatttccagaagatgtaaaaaacaaggcattagaattaaatttccattccgaaacggtctgattttaatcaagttttaaatcttcctctccaacttttgtaacataatttccattccgaaacggtctgattttaattaggccttactatgaacgtattggtaggtctgcatgggacttaatagatttccattccgaaacggtctgattttaatagaaatccaaggagaacctccctcctacctccctgatttccattccgaaacggtctgattttaatagggcaatcattcacaacataatatacttcatcactcttaatatttaagcttttctataccatatttttctaagggtaagtaactactccataatataaaccttttaatatttaaaattttctccctttaataaaacagagcattcttatctttttaaatccaaaaatttaacttattagttagagaaattttatttacttgcctaattaatcttaattttcaaaaatctgaataatttgattaagttaaatattctaaacaatcaaaccagcaaacccttagaaattaaatttaaaacctctaaataaacgaataaagttttaaagaaataaagctaagcaatattaaatttttcacaagatactaacttatgaaataatcttatcaatcatatctaattgtagagccatctttatctctcttgcaattctctgccccatactcaatggctctccattgtataggaaagagtaagggccaccattcataaagctgtttgttccaccatcaactcttgcactcatttcaaagacaactaattcaagattctcattacataaactctgcaaacagaaaggtccaatcattcctggtggaacaagctctttagccttagcaactaacttatcccccatctcaaagacttgaggtaataaactctccctaataacaactggaatatttccagtaatcacatagcttggatttatattcatctctaattggtcttttgctggaattctaactaaaccatctatattactttcatatctcttgtccattcccaataactcaacttcatccttcaatggagagtagaaataatgtatgcagaagttagttccaacaacatactcttctatatgtgcgttggctatgtcttcatcagtcaatattcctcttttctttaaatcctcagcttttttataaaattcctctgttgatgaagctataaagtaacctcttccacctcttgcccctgggaatttgactataactgttccatcaatgtcttctgggctttcatacttcttaggaactcttaatccagcttctctcaacagctttccttctaagcttctctctgattcccatcttaatattctcctattcccaaacattgggactaaaaaactattttccacattgtctaaaccacagtatgcaataaaagagccgtgtggaactacaatagaatttaactctctcaatttctcttgaatctcttcattttttatgtcagaaaagttatcaacatatataaatttatcagcaactttaaatctcttgtatggaacatctcttcccttcatagttatacaaacagtagaaaagccttctaatttagctccttttaaaatatgcaaagaggtatggcttcctaatgttgctattgttatctcatctttgttgtatttatcaaaaatctctaaaatctcatcttttgaaatcatttatttcacctaattatagttttttgcaaatatttaagatggataaggcattaatgaacgccttccaaaggaaggcgttcaaattttcattatgaattttaatgacttttgcaaaaaactataggtttttgtagtattttaatattctttaaaaaagcatataaaatgcttactgcttaaactaagtagaaattattatatagagataaacttatgagcagaaatgcatttcctatccatagggctccgccctattgggatacccgacgtccattaagttggggctttcagccccaattaatgtccaatttagctatgtaatacttttagatttcgttttaaaaaagaggtgcaattatgataattattggtattgatgaagctggaagagggcctgttttgggtccaatggttgtttgtgcttttgcaattgaaaaagagagagaagaggaattaaagaaattgggagttaaagatagtaaggagctaactaaaaataaaagggcttatctaaaaaagttacttgaaaatttgggttatgtagaaaaacgtatcttagaagcagaggaaataaaccaattaatgaactcaataaacttaaatgatattgaaattaacgccttttccaaggttgctaaaaatttgatagaaaagttgaatataagggatgatgaaattgaaatttatattgatgcatgcagtacaaacactaaaaaatttgaggatagttttaaagataagatagaggatataattaaagaaagaaatttaaacataaaaattatagctgaacataaggcagatgctaagtatcctgttgtttcagctgcctcaataatagcaaaggcagaacgggatgagataatagactactacaaaaaaatttatggagatattgggagcggttatccatcagacccaaaaactataaagtttcttgaagattactttaaaaagcataaaaaacttcctgatattgcaagaactcactggaaaacatgtaaaaggatattggataaatcaaaacagacaaagctaattatagagtgatattatgtttgcttataaattgttagtggatgagagagggaagagatatttgttaaaaaagaatgttgagaagtttggaacagatttgggaattgtagatatgaaggatattgaggaaggagttgagttaaaatcccacaaaggacatactttctatttggttgaacctacaatgtttgatatcttaaagagaatgaagaggacagtaacaaccctattaccaaaagatattgggtttattatagcaagagctggaattagagagggagagacagtagttgaagctggaactggctctggagctttaactatgtatctatcaaatgctgttggtaagacagggaaagttattacttatgatataaggccagaatttgccaaagttgcaaggaaaaatctgttgagagttggagctattaaaaaagggcaaaaaattattggtttagatgaagagtttgatgatgaggatgagattgaaattgaagatggattattcaatgtcatacaaaaaattggagatgttagggagaagatagatgagaaggatgttgatgttattgtcttagatttaccagacccctggaatgttgtagagaatgcaaaaaaggctttaaacaaaaagagggggagaatagttacttatctcccatacatagagcaagttaaaaaaactgtagagaagcttaaagaggaaggattttgggatatccacacctatgagattattgagagagagattgaaatctctgaaaaaggtgttaggccatcaacaaggatgattggacatactggatacataactgtcgcgagagttccaccagagcctttagatagagaagaagagaaagaataaaaataatttacacctccgagcgtaagcgaggaggtgttagggtatcccaatagggtttccctatggctggatatataacggttgcaagagtcccccctaagcctttagataaagaagaaaaagaggataagaaagaaaatgaatagggaaattatgttgatatttggcactgctggagttccaatatctgcagaggatgaatttaaagctgtagatgtcttaagaaaattaaatttaggagctatggagttggaatttgttaaaggagtttatatgaaagaagattatgctaaaaagttgaaagagtatggagaagatattattttctcagcccatgcccctcactatataaatcttaatgcaaatgaggaggaaaaagtagagaatagcataaggagaataattaaaactgctaaggttttgaataattgtggaaaaaatttagtttttcatcctggatattatttgaaaagaagtaaagaagtaacctacaatagaataaaatcaaatattcagagaattttggataagttagaggctttaaatttaaatgttatgctaaggcctgaaactactggaaaaactactcaatttggagatattgatgagacactaaaattatgctttgagctgaatattttaccatgtattgatttctcccatatttatgcaagaagtaggggagttataaacgattacaactctttttataaaattcttgaaaaagttgagaatgttttaggaaaagaggctataaaagatatgcatattcatttatctggaatagaatatggaaaaggaggagaaaggagacatttgcctttaaatgaatctaactttaactatagagatgttttaaaagctttgaaggattttgatgcctctggaactgttatatgtgaaagtcctatgttggagtatgacgctgttttgttgatgaagtgttataatgagttgtagataaagtatatataagagataggtagattaaattaaaattatctacctaattttgtatggtgatacaatgctattagagtttgcagatttagacaattgggttaaaaaaagaggaagtattttatttaaaaagtttaaatatgaaccatttaccttagaagaggcagataaagctttaaaagaagaaggaattgaagcagagaatacaaaagagcttttatctattttaagaagaaaggaaataattatagcaaagaaagaccctaaggataaaagaaaaaggttatatcaatttgttaaatcagcaaagaaaccaacaaaagataatttaataagaaatctaaaatattgtgcagatttaattagaacgagtgttgattacaaagtgttattggtatttttattttataaggcaattagtgataaatatctggcattagttgagaaattcgttagtgagggatattctaaaacacaggcttatctaatggcaaataggagttatttaacgctctatgatgaagatgaaggaaagttgtatgtttggcatgaaattgttaaaagtagagagacaataatggagttggcaaatgcattaaacaagatagcaaatcttaatgataatttaaaagatttatctaaattggttgaggttttggggcttattgggtttattaatgaggataacatgcatattttggaggaattggttagagtttataatgagatggacttttcagagattgattatgatgctattggtgatgcatatcaatggattttgtcatactttgcccctcaaaaatgtaaagagggggaggtctatactccagtagaggttgttaggttgatagtgaatttgttggatattgaaaaagatagtgaggttttagaccctgcctgtggtagcggaactatgctgattgaatcttataggtatgttaaagataactatgggggggagatttatctctatgggcaggagagaaatgagattatggcaattttggcaaagttgaatttgatattacatggagttgatagtgaggagtatgagatttatattggagatagcttaaaaaatcccaaaatttggagaggttgattataccattgccaatccaccatggaacttggatggatataatgaagatgttttaaaggaaaatccagatgttaggaggatttataacacttttgttagaggtggttatcctcctaagcagtcagcagattgggcatgggttcaattgatgttgtattttgcgaggaaaaaagtgggaattgttttagattcaggggcattatttagaggagggaaggagaagaagataaggaaggagattgttgagaaggatttaattgaggctattattttattgccagagaagttgttttataatgttacagctccaggaattgtgatgattttaaataaaaataagccagaggagaggaaggggaagattttatttataaatgcatctttggagtttgagaagcatccagaggttaggagattgaatagattgggggaggagaatattgataagattgttgatgtctatgagaattgggaggatattgaagggtttagcagagttgttgatttagaggagattagaaagaatgattataatctgaatgttagcttgtatgtctttccagttgaggagaaggaggatattgatttaaggaaggagttagaggagtttaaggagattgagaagaaggagaaagaggttttagatgaagttattggatatgttgagggaattttaagggctggaagttaattaaaaatttattttttggtgaaaatatgcctggtgtaatattttggactatatttatcattcaatttatgatttgggtatttcttagcactacaaaaataggaagagttattgcatttatttgggggacaatgccatttttggcattatatttgaaatatacgggatattttccaacaatttttgaaaatccggatgttaatttatttgctaatttacttagtaatttcgttgttgagtggagttatttagtagttcaaacaaccgttccgtcatggataggtttgctttttggtttaaaattatctggaaataatgatactcctcaaattatttaatttggagggatttttatgttctataaagaagagaattttaaaaaaacagagattggagagattccagaggattgggagattgttgagctaaaggatgtttgtaaaaaaataaaagcaggaggaacaccaaaaaccagtgtagaagaatattataaaaatgggactattccatttgttaaaattgaagatataaccaattcaaataaatatttaaccaatacaaaaataaaaataactgaagaaggtttaaataattccaatgcgtggatagttccgaaaaattctgtattatttgctatgtatggaagtattggagaaacagcaataaataaaatagaagtagccacaaatcaagcaattttagggataataccaaaagataatattttagaaagtgaatttttgtattatattttagctaaaaataaaaattattactctaagttaggaatgcaaacaacacagaaaaatttgaatgctcaaatagtaaaaagttttaaaatccctctccctccattagaagagcaaaaacaaatagctaaaattttaactaaaattgatgaaggtattgagattattgagaaatcaattaataaattggagaggattaaaaagggtttaatgcataaattattaactaagggaatagggcatagtagatttaaaaaatctgagattggggagattccagaggattgggaagtttttgagattaaagatatatttgaagtaaaaacgggaactaccccatcaactaaaaaatcagaatattgggaaaatggagaaataaattggataacaccattggatttaagcaggttaaatgaaaaaatctatattggaagtagtgaaagaaaagtaacaaaaatagcattagaaaagtgtaacttaaatttaattccaaaaggttcaattattatatcaacaagagcaccagttgggtatgttgcagttttaactgtagaatctacatttaatcaaggttgcaagggattagttccaaaaaataacgattcggttaatactgaattttatgcttattatttaaagtttaaaaaaaatttacttgaaaatctaagtgggggaagcacttttaaagaattatcaaaatctatgcttgaaaactttaaaatccctctccctcctttagaagagcaaaaacaaatagctaaaatattaagttcagtagataaaagcatagaattgaaaaaacaaaagaaagaaaaactacaaagaatgaaaaagaaaattatggagttattattaactggaaaagttagagtaaaaacttagattttaatcaaccacaatatataaaaccataacttaacataattaatgataacaaaaaagaggttgatgactatggaattaaatccatttgttgttggagttatagcaattgggattattatgattagtgtggcagttcttttttactataatgtcagtaagatagaaaaggaggtaagttaattattttctaatttyttaagttgttttattataatagagtaagtttttagaaataacaacataacaacaattactgagattgttatcattccaatcataactataaaatcaattgtaggctttggatgttgtatttggtataaaacaattgcggatattgttaaaaatgcatgatttgttaaagatgaaaacatttcaattgtgaatttacataaaaatttgtatttatcatattttgatagataagacagctctctatgagtaaatccaaataaaaatagaagcaaaccatacaaaaatacaaaaaccgttaaaatcccagcagtaataagaaataagctaatattttgcgggtagaagatataaaatacaattatcgatagtataatggtaatactaccatttacaactgccaatatcatcttttgaatcactgaaagatgagctttatgttcattaaccataactatcacaaaaattaagaatgacataacaacaaaagataacatagcaccatttatataaagaaactttattttaagttaattactacataatatttaaaatttttctctaattgttaaagttggaaaacaaggaaaaacttaaattcttaaaataaaattttattattaataaaaatttggtgaaactatgaaaaccatctctgaaataaaagatatcctaagaaagcataaaaaaatactcaaagaaaaatataaagtcaaatctattgctatatttggaagttatgcaagaaatgaacagacagaaaaaagcgatatagacattttagtggaattttatgaaactcctgactatctcaaattctttgagttggaggattatctatcagatttattaggaattaaagtagatttagttattaaaggagcgataaaaaatccttatattaaaaaatctattgaagaggatttaatttatgtatagtggtgattaaatgcctaaaaaagatgttagagcatttttatatgacatcttagagaatatgaaagatatcatcgatttcacaaatgatatgacatttgatgagtttttaaaagataaaaagacacaaaaagcagtgattagaagtttagaagttattggtgaggcagttaaaaatcttccagaagattttataaataaatatccacaagttccgtggaaaggcatggcaaggttaagagataagttaattcatcattattttggaataaattatgagattatttgggatattgtaattaataaagttccaaacgatataaaagaaatagaggaaattataaaagacattgagggagaggatgaaaactctatctgaaataaaagaaatcttaaggaaacataaaaaagaattaaaagaaaaatataaagttaaatctatagccatatttggctcttatgcaagaaatgaacaaactgaaacctcagacatagacatattaattgactactatgagccaataagtttattaaaattgatagagttggagaattatctatcagatttattggaaattaaagttgatttaattacaaaaaactctattcacaacccttatgtaaaaaaatccattgaagaagatttaatttatatttaatggtggttaaatgccgaagagagatataaaggcatttttatatgatattttatcctacatggatgatataattaacttcactaaagatatggattatgaggagtttataaacaataaagcaataaaatacgcagttattagatgcttagaagttattggagaggcagttaaaaagataccaaaggatattagagaaaaatatccacacatcccatttaaagaattggctggaatgagggataaattaatccaccaatattttggtgtagattatttaacagtttgggaaactgcaaaatatgaaattccagagataaagaaagagtttgaaaagattataaaagaccttgaagaaaaataaatattgattctttgattattctaatgtggggattattatgataagagaagaatatttagatgttgagaatataaaagaaaaacttcaagaaattggatgggaggatggaaagaaatacattaactttaaagaatatcaantaatccctgactactatntaccaaacttttttgaagaaaaatttaaggagataaataaaactctactaagttatttaactccaaaagaggttaaagaagttattgattttataaaaaatgaacttaaaaatgcagatgaaataaaaatattggactacctaaaatacggtattgaagttgtagttaaaaaaagtgaaaaaagaaaatttaaactcattgattataaaaatatagataaaaatacatttttttatttatgcgaagcagaatttaaaggaaatccaaaaaattcaagacctgatataactttgttcattaacggaatccctgttgtaataatagaggcaaaggcaacattaaaaattgactctcatttagaaggaataagccaaataagaagatatgaaaaatttagccctgatttatttaggttcgttcagtttgcaatatcttatggagaagagcagttatatactccaacaatgccaaactggtataaagaaaatatacacttaccagcatactattggagaattagacaaaaaattaatggaaaaaaggttgttaaagatgacatcttctatatcttaaatccaagcatattgcttgaaataataagatacttcatattttacagaaaagacgaatacagcaaaacaaaaactttaagcaaaatcatcgcaagatacaaccaatactttgccacaaagaaggcaatgaaaagaatagatgaatatttaagtggagacagtaaaaataagggtttaatttggcactggcagggtagtggaaaaacttacactatgttttttatagcaaattattttttagacaaatacttctcagaaaatcctgttattttctttgtagttgatagggttgatttagaaaggcagagtaaagagttttatgaagcaatccaagagaaaaaatttaaaaccattttaaaaagaattgacagcataaataagctttatgaagtcataaaatcaataaaaatgagtgaattaagtaataaagttattgttaggggtatttacacaacaacaatacaaaaatttcaatatgaaagaagtaaaaaagaaaaggataataataaggaaaaggataaagatgacgaagatttggatttatcaaaacccattgaagagattatcaaaaaaattgaagataaattaaaaaaagaagaaaaagaaggaaaaataaaaggattaaaagaccttttaataatattggcattcatatatctaaaacatctaaaagaaaaaaaccctgaagaatataaaaaacatatagaaaacctaaaaaaactaaaagataaagataaaaaagaagaatacctaataaacttaggaaatatcaaaagaaaacatattctaatactgatagatgaagctcacagaacacaatacggaattttgggaggtatgagaaaaataacatttccaaatgccattacatttggatttacaggaacaccagtatttaaaaatgaaaaaaacacatttacagaattttcgtatccagaaaagggagagttttatttagatgtgtatttcataggagattccataaaagacaaatttaccctcccattaacttatcaaattgtaaaagaaggagatatcaaatcagaaggaattcaaattacattggatgaagaagatataaaagaatttattgatgagtggattaaaaggggggaagatattaacctatttgatagaaaaaaacttccaaaatatataaataaatcaaaaacaattttattaaaccccaaaagaattgataaagttgcaaaatatatagttgataggatagaagaagatactgaaaacttcaaatttaaggcaatggttgttgcagtcaatagattggggtgtgttagatttaaaaaagcacttgataagtatttaaaagaaaagtttggagatgaggcagagaaatgggctgaagttgtgatgacatatcaccacaacgaagaagagaaagaaattattgaatacatgaaaaaacttaaaaaagaaagaaattctaacgattttaatgagattaaccaaattattagagaagaattcttaaattcagaaaatccaaaaattttgatagttacagatatgcttttaacaggctttgacgctccaagattaaaggttatgtatttggataaaccactgtatgggcatagattactacaagcaatagcaagaactaacagaccatatccagacaaagaatttggtttaatagttgattctgttggattatttaaagttttaaccgaaactatggcattatacaacatgttggcggaggaagagattagggaagatttcaaaaacaatttaattagttcaattgatgagattttccaagaatttaaattaaagttagaaatggttaaagaatcattaaaaaatttaaaaattaacgatgaggatttaagcatagatgtaaatactcttaaaactttaacaaaaaacaaagatttcaataacaatgagttaaaagaaaaattggatttaattgcattttatgcagaagacggaaaaaatgcgagaattttaaagcttatagatgatttaaaagcagtaatcaaactttataaagcattaggttcttatccacaaaagattttttatattgaggatattgaacttctatccttcatatatgcttacttaataaaaaaactaaagccaaaaaagaaatcaaatagaaaattctgggaggaattaatatcatttatacacaataaaatgcttgttgatgatttaactgtaattgaagagataaatctcaaccctgatgatttagataagattttaaaagaaaatattggaaagagagagataaaaagagcagtagcaaattactattttattttaaaaaatagcatcttagataaacagcacgacccaatatataaggaaatattagaaagattggaaagattaagaagagactggattatgaagaggatagatgacaaaatttatttgaacgccataaaaaaccttatggaattaaaaaacaactacgataaaaaaataaaaggaaaatcatcaattgaaagaataaaagaatcaataagcacctatataggcgaaaatatattaaaagaccaagatattaaattgaacttagaaaatactgaaaaactaattactaaaatgcaaaatttaaataaattatcaaaattacaaagaaaaaaattcaaaaaagaattgtcatgtgcattacttgaagatttattaaaagagctaaaaggaaaaattaaagatgaagacgctaaaaaagtggctgaattatcagataatttagtttctgaattcatcttaaaagaaatatggggagagaattatgaaaatcaatgaaaataaaaaagatattaaagacattgttaatgaaattttaatttcattaaatatcaatgaaagcataaatatagaaataaaaccaatgaaacaaaaaattgcttcattttcctttaaaacaaagactttaagattaaacaaatatgttgttgaaaattttgatgaggaacttctccactatataatattacacgaacttatacactttaaaataaaatcaataaaccatggcataaagtttgagaacgaattaagaaactatttttctaagaatgaatgtgatgagattgaattaaaaatcatacaaaaacttatatgataaaagagataaaaaattaatttaaaataaatttttggtgtttaaaatgagtgaaatggatattataaaagaaacctatgaaaaaatcaaaaatatggagattaggggggcggggagaataggaagagcagcagctaaggcattaaaagaatatgctctaaaaattagccatttaaatgaagaagaattcaaaaataaaatgagagaggcaggaaatatattaatatcagcaagacctacagctgtttctctaccaaatgttgtaaagtatgtattaaagggcttaaatgaagaaaatccaaaagaaagagttatagagagagctgatgaattcatcaactcatcattaaaggcaattgaaaatataggaaagtttggagcaaatagaataaaagatggagacactatcttaactcactgcaactctgaagctgcaataagcgttataaaaactgcttacgatgaaggaaaagatatcaaagttttctgcacagagacaagaccaagaaatcagggatatttaacagctaaaaccctctatgattatggtattgatgtaaccctaatagtagattctgcagtgaggtactttataaaagagatagatattgtcgtcgttggagctgatgccataacagcaaatggttgccttgtaaataaaataggaacttcacaaattgctttaatagcaaatgaaagtagagtaccttttttaacagccgctgaaacatacaaattccatccaaagactatagttggagagctaattgagatagaagaaagaagcccagaggaagttgcagtttttgaagataaatacaaaggaataaaaattaggaatcccgcatttgatgtaacaccagctaagtatatagatgctataataacagaggtggggttaattcctccacagggagcttggtatataatagaaaaatactttggctggcttgagaaataaataattgttggaataaaatatatataccacaatttgcataaattaatatatgtcccgggtggcgaccttccgcaggggatgaaaccacctcggcattctacccacaaggcggccgtgccgagtagccgttatggcttcaatgaaggccacggttttccaagggtagatacatctttttttagaaataaatttcatctaagaggtgttttctttttttatcttttatatttattaatttaaattaatagattaaattattctgcaaaaaatcaaaaattatataaaactgtttatccaatagtaattgtaaataaccttataatgtaaatatatatatcaatttttcttataagaaaaaataatttttaggatgggaatatggaaattaaggagataacaattatcggtggttatgacaagaacggcaatccagaacctgtaagggaggttacaataaaaagaggagagattgtcggtgttgttgggccaacaggaagtgggaaatcaaatttaatcagcgatatagagcagttagctcaaggagataccatctccaagagaagaattttagttaatggagaagttcctccaatagagatgagaagagacccaaaaaagagaagaattgcccaactatctcaaaacatgaattttttagcagacatgactgtagaggagtttattttaatgcatgcgaagagtaggggagtttatagagaaaatattgttgatgaagtcatagaattagcaaatagattaacaggagagccaataaagaaagactacaacttaacaatcctaagtggagggcagtcaagaagtttaatggttgctgatgtagctgtaataagcgattctcccatagttttaatagatgagattgaaaacgctggaataaagaagcatgaggctttagagttattggcaggatatggaaagattgttttagttataactcacgaccctgtcttggctttaatgactgatagaaggatagtgatgagaaacggaggaatgcagaagattatagaaactactgaagaagagaaggaaatttcaagaaaaataaatgaggttgataactggctactctctttaagagaaaagattaggtttggagagagattgactcatgaagatataagcctaatggtgaaaggatgaaagtggcaatagttgcaggaacccctggagctggaaagacttcagtattaattcacacaataagaaccttaattaatgaaggatataagccagtagttgtaaaaattgactgtttatatactgacgatgatgtcaggtataaaaaattgggcatccctgttttagttggtttaagtaaggatatgtgcccagaccactttgcaatatacaactttgaagaaatggttgattgggctaaggataagggagatatcttactaatagaaactgctggtctctgccatagatgtgccccttacacaaaaaacagtttgggaatttgtgtcattgatgccacttcagggccgaacacgccaagaaaagtagggccgttcttaacaagtgcagatattgtagttataaccaaaggagatatcatctctcaagctgaaagagaagtttttagagaaagagttttagagatgaacccaaattgtagaatttatgaagttaatggacttacagggcagggatgtgttgaaatagccaaggagattattgaaagcaaagatattaaagatttagaaaatgaagagctaagacacaacgctccattgtgtatttgcaccttatgtgttggagagacaagagttagtaaaaagtatcacagaggaattttaagaagaatagatggattcatggaatatgaaggggagtaaaatggtcgatgtaaatgaaattaccaaatatcttccaggattcaattgtggagcttgtggttataagagatgtgatttatttgctgaggcattattaaataaagatgtaaaattagaggactgcccatttttgcttagggagagatttaaagaaaactatgaaaaattaaaagagattttaaagattaaaggaaaaattaaaaaagaggaaaaatacattggagttattgatggatatgaggcagattttctattaaaacctctaccaaatgaatgttcttgtagagagacactattaattatggataaaaaagagcttaaagttggagattatataagatatagacctttaggttgtccaattccacactttgctaaaataatcgatgagtatcatggcttttatataatccatgtagtgggaccgagccataggataactggggaaaaaatagagtataaagatgttggtatagcgatagttgttgcatttgagggaattgtagaaggtaaagttccagaggttggaaaaactgttaaatttatcccaaaacactgtatgatgcagaaggttcattctggagtagtagtgcaagttgagggaaaaagagtttatatagaaggtattgatttgaaagtattttaaaaataaaaaatatttttttaattatttattttatcatctttacagaatcttttaatcttgctgatgcatctaccatgccaatcaatcttgggtctatactgctaatatctccatacttcatataatcagttacagttggctttattttagtaaatgcacctacatagatatcatatccaaatgggaagtttcttttacatatctcttctattccatccattatcttttcaagtttttctccttcaactgttataattatctctccaactttaactctcaattccatttcttcgcctttaaccttaataacttttctatcttggtgatttacaggcaatcctcttgcaggaccaaatggaacagtttttggcaagggttgtccatgaactataaccctaacaattccatccaaatcataaatctcatttaataccttctctgtagtttctgccttcaaatatctgtgtggaaatatttttacatcaacaacctttatcacttcactcataaatttcacctcatttttcataactctactatttctttcaacctttataatactttcgataaatttaatattactttaagaaaattaaaaatttaaattttattatctaaattcataaataaagtttgcggataaacctaagtaatatatatctcttaaactcaaataatgaaaaagcaaattcaccaattcaatctttttatattactacattataattaattttaaaggaacagaatctaattttatgaggtgtttattatgagaagagaatttccagaagaaggagatatagttataggaactgtaaaggatgttaagccgtatggagcattcgtagagcttttagaatacccaggaaaggaaggaatgattcacatctctgaggttacatcaggatgggttaaaaacattagagaccacgttaaagttgggcagagagttgttgcaaaggttttgagagttgatgagaggaagggacatattgatttatccttaaagagagttactgagcagcaaaaaagggcaaaagttcaagaatggaagagattccaaagagcttcaaagatgcttgaaagagctgctgaaaaattgggtaaaagcttagaggaagcttgggaagaggttggctatttgttggaggatgagtttggggagctatacaatgcctttgaaacaatggttattgaagggaaagaagttttagatgatttagagattagtgaagaatggaaaaatgttttatatgaagtagctaaggagagtattgagctaacaaacgttgaagttgaaggagttattgagatgaaatcttacgccccagatggaattaaacaaataaagaaagcattaacaacagccttaaaagctaacccttatgaggatgttgaggttaagataacctatataggagctccaaagtatagggttgttgttatagctccagattacaagagtggagaggaggtttttaaaaaagtttgtgaaaaggcagtagcaacaattaaaaaacttggtggagaaggaacttactatagggagagtaagaaataaagataagtggtagagatgagaatgaaaaaatgtccaaaatgcgggctatatactttaaaagaaatctgtccaaaatgtggagagaaaacggtaattccaaaaccaccaaaattttctttagaggatagatggggaaaatataggagaatgttaaaaagagctttaaaaaataaaaataaggcagagtaattttctttttttatatcaaaattttacatttctgggatattatgcaacttagattatcatcaggaaatgtattaaatgaaaaagtccataaagtggggattattgcccttgggtcattcttagaaaatcatggagctgttttgccaatagacactgatataaagatagcatcttatatagctttaaaggcatctattttaactggggctaagtttttaggagttgttattccatcaactgaatatgagtatgttaagcatggcattcacaacaaaccagaggaagtttatagctatatgagatttttgataaatgaaggtaaaaaaattggtgtagagaagtttttgatagttaattgccatgggggaaacatcttagttgaaagttttttaaaagatttagagtatgagtttgatataaaggttgagatgataaatataacctttacacatgcatcaactgaggaggtttctgttggttacattattggaatagctaaagctgatgaagaaactttgaaagagcacaacaactttgaaaaatatcctgaagtaggaatggttgggctaaaagaggcaagagaaaacaacaaagcaatagataaagaggcaaaagttgttaaaagatttggagttaagttggataaaaaacttggagagaaaattttgaataacgcaatagaaaaagttgttgaaaaaataaaagaaatgataaggtgaaattatgggctgggagaatgctccatctcatatatgtaggggaggagatttgagaggtttagctttttgctgtcctccaataaaatactgtcctattcataaagcgttagctgtattgaaaatgtcaccagaggagtttataagaataaaggaagaatttggaaagaggacaaaacttggtttaggagaaaatacatgctttggtagtttagtttggtgttgtaaaataacaaaaccctgcccttacagggattatgagcttgctaaaaacaacataagtccagatgaatacatggagctaaaaaaacagcttgctgaggaaattataagaaatagccagttttttaaagaggcagtggaagtttttgttaaaaaaggcattccaaaagatattgctgaaaaatgtatcttagagacaggagatttaaagaaagcctatgaaatggctataaaaatgattgataaggattaagataatgggattttgttttcctgaaatgttttaaacatgtcatactcttcttttgatagcttatagatggagtatttaacatcttcaacaatacacatgctctttaacaatctgtaacttttttctccatcataatcatttaaaaatgcatatactggttttccatctttagctacaatatatccaatttcactaccctcaatcttaattaaacatgttccgtaagatagagcatcaatcaatgaaacattttctaagattataggtttttttgaagatattattttcttaacaacatcgttaattgaatctccaaacaataaaacgccttcaggatattgattttttaaagaatttaattcttcattggatattttctcaatttttgcaattatttcactaacggcaaatgttgtttttagtttgctaattgctttcttcccaaataaagtttttctaccaaaatatactgcaaaaacctctctcttgtttttataaacaacaatccctttttcatttttaaatctttttggcataaaaataactttatttatgtaagttaaatatttatatacatcgttgtaagaattcaaaataacctcattctcaaaaaccaggcttagcttagaaatttcaacaatagattcctctggtttaaaatttataagagcagattttacttccttttcatttccttgataaatctctattaaaaactcgtctggaatttgtgaaaatatctcttctaaacttttttctctaccattaaactttgatgagataagttttgagtcaatgtaaaagagaagggcattgtctattctaataattcctgtaaaattaaccaatccagaaataatttcttttaaatcttcaattcttccaaattttgaatacactttctccataatctcacaaaaataatgacggcgcagggggggaatcgaaccccgagggctctcgccctcgacggatctgaagtccgccccgggctaccaagcccggtaccccgcgccacattaatgggtagtaggcagtaatattgatagacatccaaaatatataaaagtttttcatacaaaatgtaatatagctattaaaatatctaataacgaatactgtttgtcaatttaagataaaataaaatattttttattttttagaaattttcctttaaaaaattgaaataataacgtttatatatgaagtttggtaataacttaatcttaatctataatgatttataatgacagattgggtgaggttatggatttaaatactttgataaaaatcattgaaaaagttggtagaattgagattgaggatataaaaatcaccgcagatgaattaattataaatatcccatcagcccctccaatagttattcctcaaacaccatcaataaaagaaaaattggctgaagaaggaattatagaaattaaagatgtcccagagttagattgggaaccaccagttgaaaaatatcctggatatataagagaagtccaatttggaaaaccaaaatcagaaggaggaagaggaaaagttgtgaaaattgggggacagagagctttatatagatttgaagaaccacagccaaatccaccagttgttactttcgatatattcgatataccaatgccaggattaccaaaaccaattaggcagtttttccaggatgttatggaagacccttgcgaatgggcaaagaagtgtgttaaagaatttggggcagatatgataacaattcaccacatctccacagacccaaaaattaaagataaaagtccaaaagaagctgcaaaattaatggaagatttattacaggcagttgatgttccatttgttattggaggtagtggaaatcctcaaaaagaccctttagttttggaagcatgtgctgaagtagcagaaggagatagatgcttattagcttcagcaaacttggagttggattataaaaagatagttgatgcagctatgaaatatgaccacaacgtattagcatggagtattatggacccaaatatggcgagagatttaaatagaaaacttgttgaagctggtttggacccaaatagaatagttatggatccaacaacatgtgctttaggttatgggattgagttctcaatcaacgcaatggttagattaagattaaatggattgaagggagatgagttggttaatatgccaatgtcatctggaacaacaaacgctattggagcaagagaggcatggatgaacaatcctgaatgggggccaagagagtatagattaccattatgggaaataactactggaattacgatgatgatgtgtggagtagatttattcatgatgctcaatccaatatcagttaaaacactgaaagagattggaaaaactctaacaaccaagccaggagaggttaaactaaacacaaacaactatgagtggattgtcagcccataggaggagacctcctattgggatacctcccgtccattaagttggggctatcagccccaattaatgtccaagcttagttaaatacgtaagataaacaccaacaactacgattagattgtggcaaaggcataaaattgtaatataattgtaattattaatctaaaggtgatagaatgccaaaaaagattagtgcaatggatatttacaaattactgccaaaaacaaactgtaaaaaatgcggttatccgtcatgcatggcatttgctacaaaactgttagagaaagaggcaacaattgaccaatgtcctatattaaacaccccaaaatttgagaaaaataaaaagaagattatagagcttatctctccaccagtaaaagaagtttggtttgggaacgaagaaaaaaaggcggttatgggtggagacgaggtaatgtatagatatcagttatcattctttaaccctacaccaattggtgttgatattagcgacgagttaagtgaagaagaaattaaaaatagagctaaggaaatagagaactttgtatttgaaagaactggagaaaagttaaaattagactttattgttataagaaatgcatctggagatgttgagaagtttaaaaaagctatagaaattgttgaaaaagaaacaaagatgcctatttgcattgcctcattaaatccggaggttataaaggaagctttaaaagttgttaaatcaaagccaatggtctatgccgcaacaaaagaaacgttaaatgatttcataaaggttattaaagaagttaaaaaggacgttgttttggttttatcatcaaataatgttaaagatttaaaaaacatggctgcaaagtgcttagctaatggtattgaagatttagttttagaacctcacacatacccagaaaatatcgctgaaacattagatttgaatgtaatgattaggaggagtgctattgagaaggaagataaatacttaggatttccaatattaaatttaccaattaacgcttattattatgctttaaaaaatgaatgcccaatctctggattttttgaggataaagaggttgttgctaagatgtttgaggctacaatagccaatacattgatgaacagatatgcagatgctttaattatgcatggaatggatatatgggaattaatgccagtcctaacattgagacagtgtatctatacagacccaagaaagccacaggcagttgagccaggcttatacccaattggcaatccagacgaaaacagcccagttatattaacaacaaacttctcattaacattctacacagttacaggagactttgagaaagataacgttacctgctggctattggttatggacactggaggaaaggctgttgatgtttcagttgcaggagggcagtataatggagaaaatgctaaaaaattaattgaagagacaggaatcgctgataaagttagccacaggataataatattgccagctttagctgcttctacaagaggagatattgaagacaaaaccggctggacatgtgttgttggaacaagagattcatctcaagttggtgacttcttaagaaataactgggataagatattaaaagaatggaaggagaagaatcaaacagcttaaatacattatttaaatatttttataaaaaagaaaaattgtaggtttggaatttctgattttgttgtttggtttattgattgtcttgttgaatatgtttggattttgaaaataagagtatttaggaattatttatttagaggttttaaatttaatttctaagggtttgctggtttgattatttagaatatttgagtttattgaattattcagatttttaaaaataaaaattaaataattatctaaataagatttctctaactaataagttaaatttttgaatttaaggagataagaatgctctgttttattaaagggagaaaattttaaatattaaaagaattaaaatcagaccgattcggaatggaaactcatcacaaataatgtgtggctctccaagaataaacatttcattaaaatcagaccaatatggaataaaaataattttttatttagtctaattcaataaatttgaaaaataggaactaaatttttaactcttttagtttctaaaaaaatagaaataaatttaatagtttggatttttaaaactttttaaacatctcttctataattcttgcaaatgcgggtcttgttataaatatccctattaaaacccctgctattgtagttattgcaaatccttttaacattcccaccccaagaacaaatagaggaagcatagctgcgatggatgttgccgcagaggcaaatattataaagaaagcccttttaatgcttgcccttatcttaccagctcctctctttaatgcctcatcagttatgacaatttggttatcaactccagttcctacagcagcaataatccctgctattgaaggtaaatctaacttccaatctattaaagaagcaaagcccaatataataataacttctgatatacaggttattaaaattgggattgctatctttggctgtttgtatctaatactgactattatcccaacagctataaacgccaataataaagcaatagctgttccttttaaaaattctttaccaaattctggagatattgtagatatatattcaatatccaattttactggcaaagctccagattttagagctgaataaatagccattgcttcgtcaatctcttctttagttggagggtatgctccaacagtaataacctgctgtggatgaggttttccatcagctaagtctggagataagacaggagctgagattaactttccatccatatacaactcaactttatgatatgccttacctttagcaacttcggcaaactttttagctccttctaatgttaattcaaaaggaactccataagcccaagtttccccttgtggaatctttgttggaagttcaacattctgcacatcacttccagtatatgcagttatattgtcaatctttgctacaaaaaccccttgttgtttcaatattttaattatcctatcagtatcacaactttttggaatttctacaataatttcatcatttcctcttggatatattactacatcgtttaatccattataattcaatctttctgtaataattttaattgttgcctctatttctttgtcactcattggtttctctgcttttaaaacaataatcgttcctccacttaaatcaatcccaaaatcaagtcctttaaatacgattaagaatacagatagagtaacaaatataattaaaatcagtatttttctatctttcagtagttttgatatatccatttatcccacctatacctatataagttggtaaattttaacaaactcttttaaaatttataacatttgtggtgattaatatggactttgatataactgttatcggctatattgctggaactttaacaacctttgcatctctcccccaattaataaagtctttgaaggagaaagatatgagcaacatctcattagcttttgttataacattcacaactggactgacactctggttaatatatggaatattaagaaatgattacccaataatagtatttaacattttgtctttaatgttttggataccgataacttatttgaaaataagagatgagatgagaaaatcttaatgaaagctaaatatagaaagtggggctgaacatagtaaagcccactcggagtatagtaatagaggttcctctatatgcttgcgataccgataacctatcttaaaataaaggaagagatgaagaaatcttagatattgactattatcttattttgtatatttaaatttaaaaataaagcataggatgagaaaatgaaatgggatgaaattgggaaaaatattgcaaaagagattgaaaaagaaattttaccatattttggaagaaaagataaatcttacgttgttggaacttctccaagcggagatgaaacagaaatttttgacaaaattagtgaagatattgccttaaaatatttaaaatcgctgaatgttaatatcgtgagtgaagagttgggtgttatagataacagtagcgaatggactgtagttattgacccaatagatggttcttttaattttataaatggaattccattttttgcattctgctttggagtatttaaaaataatgagccatattatggcttaacctacgaatttttaactaaaagtttttatgaggcatataaaggaaaaggagcttatttaaacggaagaaagattaaagttaaagacttcaatccaaataatatagttataagctactatccaagcaaaaaaatagatttagaaaaattaaggaacaaagttaaaagagtgagaatatttggagcttttggtttagaaatgtgttatgtagctaaagggactttagatgctgtttttgatgtaagacctaaggttagagctgttgatattgcctcatcatatataatctgcaaagaagcaggagccttaataacagatgaaaatggagatgaactgaaatttgacctaaatgcaacagatagattgaatattattgtagcaaatagcaaagaaatgttagatataattttagacctcttataaccttaaatatttttagatactttcaacttttatagtgttagttttcttttgacctattggatgacctaatgtgattaagtaaatcccctttccaatttcttttttagccatttctctacaggtgttgattattttctccatatcatcaaattcttccatcaaacagctttcaactccccaaaccaatctcaacctttttaaagttcttatatttggcgttggagctattattttactatttatccttaatttagatattaacttagcagttcttccagaatatgttggagttataactaacttagtatttagcttcttatatagctcataaacagcatatactaaaccttcatcaatgctctcaacctctaaacaaactctatcaccaaactcctcataatgttcatctgccactttggcaaccttatttaatacctttatcgcctctattgggtattttccaatagttgtttcgttggagagcattaagcagtcagttccatcgtatatggcattagctatgtctgtaacctcagctcttgttggaaatggattgtttatcatagaatccaatatttgtgtggctgttattgacaaaattccatatctattagctattctcaatatattcttttgttcaattggaatattttctattggaacctctacacccaaatctccccttgctaccatcactccatcactttctcttgctatctcttttatattctttaatccctccttagtttctatttttgatattacctcacaatctcctttgtattctgatataatatcttttaattccttaacatcttccttattcctaacaaatgataaagcaatatattcaaagtccttttctacagcgaattttatattcttcaaatcagtttcatcaattattgggagttctatccttgtatctggaagattaactcccataccttctttaatctctcccccaacttctacaactgcgataattttatcagttttttctacaactcttagcttaattttcccatcgtttattaaaataaaatgcccttcttcaattgtgtctatattgtagttgagctttatatcctctccaataacaaccttctcccccatttttaatattttattttttaatttaacttctttaattctaatttttattcccttcaaatccataactttggcgatattatttttttccaatatattcaaaaacttttcacaataatctgttgtggcatgagacatgttaaatctaactccatctatcaaatttattgctttatctaatttattttctaaggatggtcctaaagtgactaaaattttagtttttctcatcattcccaccaaaattcattataggaacaaatcaaagtcctgattgtattttttacctatccttaaagcaatctctgccttagctaactctctaccaaaataagatgcatggtctaacttttttattaaatttaatcttatcgcggtttcataaatttcttttggtttctttcctctaattattaaaactggttctcttcttttattaaagtatattgctactatctctttgttcttcctatcaatttctattttaaaacttccttcatccaatatctgcctctcatcttcttcagctttaattattgggatattgtaactattgaaggttatttcctcctcaaatcttttatccttataatttatcaaattgtagccaatatcctttggcagagagttcctttttttagccaaaaacatcatctttgaggcaatctttaactcttttattgaaaatttacacttagcacttgcctctggtgtaaataatatattagctccaatctcagccccaatagctgctaacaaagcattgactccattactatcagcatcaaaaagctctgtaacatttccaacaccaaaaaatagtggcaatttatttctttttttaaattctctacatgcaataacgctctctataaaactgcatccggcattgtttattggctctaatattgggtcagcaactattttttcaattccagcatctattagcttttttatattctcctctaaggatttaattttgccttcaatagtctctgggacatagtttgttttataatttgttggcagaacaacaactgccgtttctgaatcttttaaatatggaattagctcatctaaattcccagcatcaacactcaaaatcatatctgcccctaaatttattgcctcaattaattcttttgtgtttaatgtatctacactaattggattgtcagttaaatctctcgctatctttagcatatctttaattttatctgcattattttcattgctaaccattcccaaatcaatcatatcagccccactttctaagtaatatattattttctcctccaactctttctcttttagccatggggcatggactatctctcccaaaactctcattgggaatttatctccaacttttaatttgcctatctttatatctccttctcctaattcctgctcctctgctttcttaatctcctcctcacatttctttctaataatttctaataactgcaaatcggcatactctttagttgatagttttatcttatccagattttcaatcaatattggaatatcagaagcttctcttgtagatttaaagcattttattccggtttcttcctcaacattctttaaatcatgtcttatcaacccagttactaaaacaaaatcataaatatcttttaatttttttcctaatttgttttctaattttttaatttctttaattattaaattaggtgttaaaaaagcagctacagagatatttgctacatgcacatctataaaatcatattttttcacagcatctttaactttcctttcagctaattttccagtgattattagaattttcataatctccctcaaactttcatagtcaatataagatttaggactttcgtagaaataaattttttaaagaaaatttatgcttaagggcatctaaatgccttttaatatataatactgcgaaagtcttaaaatgaaaactataaatgtaattaaattaaaacataatttatacttagctaaatttggtggatagtatgaagttcgtagaaaaagcaaaaatagagtttgaaaatcccatagttattgaagcatttcctggaactggattagttggaagcatagcaggttttcaaataataaaagacctaaacctaaaatattttggatactttgaagttgatggaatccttccactcacaactattgagaaaggcattccctaccctccagtgagagcgtatgcaaacaaagattttattattttattttcagatataataatctctccatttaagattaatggattggcggagtttatagttaaaacattttcaaacaaaaatccaaaactatttgtttctcttggaggaataatggcaggaaaatcagaaaaagtatttggaatagcaaataaagaagagttgatagaagatttaaaaaattatgttgaaatatttgattttggagttgtgggaggaatggggggaaatttattaataaaatgccatgacaatgggtttgatgctattggtttgttggctgaaactgttggaattagaccagacccaagagggggggctaatctattagaggttttgaataaaatgttcaatctaaatgtaaatattgaaaatctcatcaaagaggctgaagctattgaaaacaaacttaaagaactggcagagcaacatttaaagatgatgtcaaagagtagaaaggaatatccaatgtacatttaactaccataggaggaaacctcctattggtatgaaccttttagtaaaaggttcatcaaaacctaacacctcctcgcttatgctcggaggtgtaaattagcaatattaggggagtatcccaagaggggcgtagcccctttatggtgtggataccacacgtccattaagttgggactttcagtcccaattaatgtccaatctgaagattttatattgtttgaatatgctaaaactttcgaattggtattttggtggtattatgaaggtttatggattatttggaattaatgaaaatgcaattaatgattttattgaaaatcatataaagacattcactataatcaatgcattaaacttagagacagttaaaaacctaaaagaaggagatttggtttttataacatcaacacttagggaagatttgaggaatggaactgaaggaattttaggaagggttataaatgtctctttagtccctcaaatgataaacggctttgaagagaaggaaattatagctggaagggttcaattggaaatgttgggatttgctaaatgtgttaaatatgaatccatccatgtagagataacatttagaatgtattaatttatttttggataattttatttttgtgttcttcttcaacagattttgcccactttatcatttcattatagactttatcttgcttcaatagattttcattgcctatcaaaattagctttctcttagctcttgttatggcaacattcaacctcctcaaatccttcaaaaatccaaagttctttgttctaacgaatgagataactatagcctcattctcccttccttggaatccatctactgtattaacctctatgtctatgttatgctcttcaaacaacctcctcaaatacctaacttgggcatcgtaaggagttataacgtttgttggtatcttatactttacaagttttttaactatctctaaaaccttctccgcctcttctatgttgtaataagatggagattctttatctttcctttcaatcccttcaacatttataaattgaactgggatttcgtttataatatctctatcaacctcatcaatctcctcctctttaactaaatctaataaagtgatgtttttaacgctctcatctgcctttaatttgttgttataaaacatcttatttgggaattccatgattttttcgttcattctatactgaatctccaatattgatgaaaattctggatattttttaatcaatctctcaaataaagtcttttttagctcttcattctcacttaaaactgttggtggtaattgcttatggtctccagccatgattagctttcttcctttaacaattggaattaagcaagaaggctccattgcttggcttccttcatcaataacaatcacatcaaactcccagcctttcaaaatttctgaaccagccatagagtttgttgctacgataacatctgcctctgctaaaatctcattcatgattttttcagtaatttcatccaaattattgatgattcttttaatctttttatttcttataatccattctgccatactaacgattttttccttaggaatccctctgtaggatttctttcttttagctacttttaaaatctgctcatcactcattcctctcctccatcttggggagggctttaaaaatttatccctctgttctttaatttctttaatcttctctcttaaagctaggatttcttgatatttctcatgattttcaattagataggggagagagtgttgaatcaaatcctttgaaatccttgttggatgccctaccctaacaacttttaaatctggatatttttttattaggtactctaagatgttatctgctgctatgtttgaatctgctgtagctaaaaccttatgtttgttaaatttaacctcttggacgataacctctgttatagttcttgtctttccagttcctggagggccgtgaattaaatacaaatccctacttaaaactgcctttttaactgctaatttttgtgattcatttaaatttttatcatagaactctaatttgatgtcctctcttaaaggtttttctgggtgttcaatgcctaatattatataagctaatttatccctctttcttgcaaattctcttaaagcttctttcattcttttaaatgttatgtcatttacgtataaatcaactcttactctttctttataaacccattttgggacatcaacatcaaaggcaacatctataaagttctttcctacgtatatgacattcgcatataaatcactctgcaatgggttttctttactaactaaaacaacgtctcccggagatatttctgttttaaatggcttttttctcccaaatcttacaatggtgcaacctaagctctctcctaaaaatttcccttttaaatttaaaattgctcttccaacattctctctctttttgcctaatttaataatctcatttttatgaaaatccatctcacatcttctctcaatctcaatcaaatccatgaatttctttacgtataaatcaactaaattcaagctatcaccacttttaaaccaattctgcaactattatattatccttatttctcaaaattctcactttaactgtcttccctattagattttgttcattattgcagttaattatctgaattaccctatccttagcaactcccaaaacttctcctttaactcttccatctaaaacaacttttacttttgttacctcaccaactttgaatggataaggcaatcttttcctcttatgcgttccaaaatcctttggtgaagttatgagcttaacctctatacctttcttcttatattctaactcatatttccctaacaaataataaaacttctcaaaatcccaaaccttcatttttttaggtcttctacctaattgataaaccctacaaagttggcaacctaaaatggggtcttttttcccggttaatggattaataatgttttgaggatttttctgctctaaatcaacagcatactcaataactctcttaaattcctcatcgtttatgtttggcaataaaaggggagcaatcaatagatgaatcttagagttttttatatattcagcaatatctaaaatcttcttaatattgtaatctctcctaccagagagcattttagccattttttcatctaaggcattgatagataagtttatcctatgcaacccggcctcttctaactcatctattagtttataatttaaaactgtcccgtttgtttgcatggaaacgataccattaccttttttatttatctctgccagttcttgaactaaatcaactaatggataataaaggcttggctctccctgcccatctaaatgtgcctcaataaacttattttccttaaaatcaacaatctttttgtaattctcaattaaatactctaaatcaacatagtaatcattttttcttgttttagaaaactctccttcatccactgagcaaaatatgcagtttaaattacagccacaatgccctctaacttggattatatttctacctctttcaattaaaccaaaggcagtatgccctattagaggaattggctcatttatatatatagtttttctctttgttattttgctctttaaattgttagctatgctataagaaattaagtttaaaatcccaacctttatattttcagctctttttggatgagcattaatttttattattgagccatcaatttcaacctcttcataaggaatttcaacttcaatctcataaattttgtttatttcaaggattaatgtgttatctttgtttttaacgtcggttatcatcctgtattgtgataaatctaagcacaccataatcccacaacattcaaatatttacattaattaaaaacaatttaaacaatcttgttatattgggttattattattctaaaagaagattttgcagttactaatattgtccaaattaaaaaaagctcaaaatatttggtgcgggggatggggtttaaagcatagggcttcgccctattgctatacccaggatacattgcttcctaatggaagcaatgcctcttctaacccgctatcaaatatttggtgcgggggacgggatttgaacccgcgaacccctacgggaccagaccctcaatctggcgcctttgacctggcttggcgacccccgcccttaaaggcaaattttatttataaacctccctatataaaacttacgccgaaaagtatatatatgggtttgtaattataatgatgttgcgtgccgaggtggcttagctggttatagcgcccggctcatacggatatcccaggctttacgcctgggtcctgggaaaccgggaggtcgagggttcgaatccctccctcggcaccatttttattccatagggcttcgccctattgggatactcagagcagggttgccagaggcaaccccactttcttttaagaggcattgccgagcgtagcgaggcaatgcatcctattttgatgaaatggaaagctacgctttccagctatgaaaactcttttagttttcatttaaccgaagcgttagcttcgggctacaaaatctgaaagattttgtttaactttttctaaaagtttcgtttgtatccctccctcggcaccattttattattttattttaggttgttatatttatttttttagatttatggattaactatttttaaatagtatttattttttaaatcttaacttaacagtttttaatggtgaatttatgaaaattattgtttgtataaccggggcgagtggagtcatttatgcaaaaagattgttagaggtattgaaagatagagctgaagttaatctaattatctcaaattcagctaaaaaaataattaaagaagagcttgatattgactggaaagaaataaaaaaattagcgacggactattatgagaatgatgactttttctcacctcttgcatctggttcaaacaaatttgatgctgttgtagttgtgccttgctcaatgaaaactttatcagccatagccaacggatactcagcaaatttaatagttagagtttgtgatatcgctttaaaagaaagaaggaaattgataattatgccaagagagatgccatttaatagcatacatttagaaaatatgttaaaactttcaaatttgggagctatagtaatgcctccaattcctgctttctataataaaccaaaaaatgtaaatgatataattaattttgttgttggaagagttttagatattttgggaatagataatagcttatttaaaagatggggaactgtttaaagtataattctaaaatttctgaaaacaataaaatttttaattgaagaaatataatattttattaagtgttgtatagtttaatttggtgatatcatgctcgataaattaggagaaaatttaaacaaagccctaaacaaactaaaagctgctgcctttgttgataaaaaattaataaaagaagttataaaagatattcaaagggctttaatacaggcagatgttaatgtaaaattggttttaaagatgagtaaagaaatagagaggagagctttagaggaaaagacaccaaagggtttatcaaagaaagagcatatcataaagattgtctatgaagaattagtcaaattattgggagaagaggcaaaaaaattagagttaaatccaaaaaaacaaaatgttatcttattagttggtattcaaggttcaggaaaaacaacaactgcagcaaaattagcaaggtatatccaaaaaagagggttaaaacctgctttaatcgcagctgatacctacagaccagcggcttatgagcagttaaagcagttagctgaaaaaatccacgtgccaatatatggggatgagacaagaacaaaatcaccagtagatattgttaaagaggggatggagaaatttaagaaggcagatgttttaattatagatactgctggaagacataaagaggaaaaaggtttattggaagagatgaagcaaattaaagagataacaaatccagatgaaatcatattggttatagatgggactattgggcaacaagcaggaattcaagctaaagcgtttaaagaggcagttggagagattgggagtataatagtaactaagttagatggttctgctaaaggaggaggggcgttaagtgcggttgctgagacaaaagcacctataaaattcattggaattggggaggggattgatgatttagaaccattcgaccctaaaaaatttatatctcgactgttagggatgggagatttagagagcctattagaaaaagctgaagacatggttgatgagaaaacagaagaaagcatagatgcaataatgagagggaaatttactttaaatgagttgatgactcaattagaagcaattgaaaacatgggttcaatgaaaaaaatcctaagtatgattcctggatttggaggagctatgcctaaagagctttctcatttaactgaggcaaagataaaaaaatataaggtaattataagttcaatgactaaggaagagagagaaaatccaaagattattaaagcttcaagaatcagaaggattgcaagaggttctggaactacagaaaatgatgttagggaggttttaagatattatgaaacaacaaaaaatgccatagataagttgagaaagggtaagatgttgagaattggaggacctttaggacaaataatgagacaattaatgtttaaggaaggataattcttttttattttctatttagcaattttaatctcagatataatagaatcaaatactttagaagtttaaaatttttatatctctttttatatattttagggattacctatagtgtttttcaaacttaataaaatttctaaggcacttatataaaagcctatagggcttttataaataccttataccgtaaaacatttgaaaaacactataaaaatttgtagaggttatgattatgaaaacaatcaaagagattaatgaaaagattaaaaaaggagaggctgttgttgtaacagcggaagagatgataaaaatagttgaggaagaaggagctaaaagagcggctgattatgttgatgttgttacaacaggaacatttggagctatgtgctcatctggagtatttataaactttggacattcagacccgccaataaagatgttaaggatttatttaaacaatgttgaagcttatggaggtttagctgctgttgatgcttatataggagctgcacaaccgaacgaagacccagatgtagatattgattacggaggagctcatgttatagaggatttagttagaggaaaggaagttgagctttatgctgagggatatacaactgactgctatccaaggaaggaggttaatgttagaataacgttagatgatgttaatcaggcaattatggttaatccaagaaattgctatcaaacttatgctgcagcaacaaacagtagggaggagaaaatatacacctacatgggcattctacttcctgaatataacaacgttcattattcaggcgctggacagttaaatcctttacagaatgattataacccagaaacaaaatcatttaataccataggtattggaacaaggattttcttaggaggaggaattggatatgtaattggtgagggtacacagcataacccaccatttggaacattaatggttaaaggagatttaaaacagatgaatcctaaatttataagggctgctacaatgccaaggtatggaagcacgttgtatgttggtataggcatcccaatcccagttttaaatgaaaagatagctgagagatgtgctattagagatgaagatattgaagtgccaatctatgattatggatttccaaggagggatagaccattaatagcaaaaacaaactataaagtgttaagaagtggaaaaataacattaaatgtaaatatagatgggaaagatgttgaaaaaaccgtaaaaactggttctgtttcaagttataagatggcaagagaggttgctgaaaccctcaaacagtggattttggatgggaagtttttactaactgagagggttgatactttaggaagagctgaaaacaagccaatgaagtcaccaataacattagttaaggatattttaagcaaaccaccaataactgctcatagcaatatatccattatggaagctgctaagattttgataaagcataatataaaccatcttcctatagttgatgaacatgggaagttagtgggaataattacatcgtgggatatagctaaagctcttgctcaaaacaaaaagacaattgaagagattatgacaagaaatgtaataactgctcatgaagatgaacccgttgaccatgtagcgataaaaatgagtaaatataacatttctggtgttccagtggttgatgactacagaagagttgtgggcattgtaacatctgaagatatctcaagattattcggagggaaaaaatgagaaagagagtgtattactggacagattcagagcatataaacaagccagttatttccgatactatattaaatacaggagttaagataaacatattaaaagctaaggtagagccacaggaggcatttttgatattggaattgtttggtagtaaagaaactatagagaaagctttaaattatctatcaaaatttggagaagttgaggaaatctctaaagttataaaaagggatttggagaagtgtgtgcattgtggctgttgcataacccaatgccctattaatgtaatttatatggatgaggattataatgtagtattcaaagaagaggactgtgtcggctgtaaaaactgtttaaaagcctgtccatttaaagcaattgagatttttgagtaatatatttatcacgctgaaagagtttagacttatgtttaataaatttaaaggctttatttctttawttaaataatatttatttaatttctaagggtttgctggtttgattgtttagaatatttaacttaatcaaattatttgaatttttgaaaattaggattaattaggcaagtaaataagatttctctaacaaataagttaaatttttggatttaaaaagataaaaatactctgttttagtaaagagataaaattttaaatactaaaaggtttatattgtaagatggttatttatccttagaaaaatatggtatagaaaagcttaaatattaagagtgatgaaatatattatgttgtgaatgattaccctattaaaataagacctcttggaggatggaaattaggtagagaaatcacggcaaaaacaggtagagtaacaattaaaataagacctcttggaggatggaaatctttatccttatcaatcttctgttttggcatgattttattaaaataagacctcttagaggatggaaactaattttattatatgggaattctgcttgcaaatttattaaaatcagaccgtttcggaatggaaacaatttaaacaaaatatcgcaaaatcagatttctggaataaaatactaattaaattctattttttaaatatttataaataaatttataacttcaataataggacttttgtaggagtaaatatttcttgacttatatctaccttcatataaattctataatgttttgaaagatactacaattctcatataaagataatagtatataaactgctaaagtcctattcaaagaaggtaaagtttaaatagcataatctgctattatagtcaatcaatgtttttataacaacaaaaagaggatatatggttttttgcaaaagttattaaattgacgaaggaagattgamcgccttctataagaaggcgttcattatatgccttaatgtattctaaatatttscaaaaactataaaaacacaaattaaagattttaaggtgataacttatgtcaaaaggaactccatcaatgggtaaaagaaacaaaggttcatatcacataagatgtagaagatgtgggagaagagcctaccacgtaagaaaaaagagatgtgctgcatgtggatttccaaataaaagaatgagaaaatattcatggcaaaataagaaagttaatggtaagagaataaaataattaaaataattaattagaaattttattcttttttaattgaatttatagtatctttcaaaacactttgaaattttccttattaataaataagctttataaattttgaaagacactatattaccatttggcaattgggatagttttttatataaattaaaagttatagttttttgataatcttattttggtgataaaatgagcgaccttgaaaatattgactattatgattataaggcattattaaagagagcaagaagtcagattccagattacgttttccaaaaagatagatttgaacttccagaaattgagattttgatagaaggaaatagaacaataataagaaactttagagagttggctaaggcagttaatagagatgaggaattctttgctaagtatcttttaaaagagactggtagtgctggtaacttagagggaggtagattaatcttacagagaagaatcagcccagagttattaaaatcaagaattaatgacttcttgagggagtatgttatctgtagagagtgcggtaagccagataccaagattattaaggagggaagagttcatttactcaaatgtatggcttgtggtgctataagaccaataagaatgatttaaataccataggaggatgcctcctattgggatatcacatgtccattaagttgccccttacaggggcaattaatgtccaataggttggaatccctttctacgagggatgctcataaaaattttgatgaaacagaaagtttcaattctggctacaaaaactcaaaaagttttcatttaatcggagcggagcgaagagctacaaatccgttaggatttatttaaccaaagcgtagcttcggtaatgaaaacctaacagtttccatctaaacgtttataaaaagttccaagggaaatcatggaagtaaaagccatggagatttttaaaaaatatctctctttaaatattccaaaaaagattttaataacctattttttgtgttgggcaggatttctgttttctttctctgtagggaagttccttttatatttatcatctattttaaaatccaattttatatctgaaccagctaaattagctcaaagtgttggaactgcaaaatttaacgctgtttcttcagctgtatcgaatactgttggggtaaaaaatgcttacttaacttatgctctttcatatatagtttctaattttatggggtgtttgattataatgtttgctcttggagcacttgcttatttatataagaaagacttagaaaaagctaaaacacttgaagagaaagaagaactatttaagtgttatcaaaaatatctattaatattatttatctttactgtcataaatccactgactggattaattggagtaaatcttcaatattctgatttaattgctgtccttccacatggattttttgaattttttggatttgccactgcagtcgttgttggagtagaattatcaaataaaattctcccaatagttaaaagagaaataacaagtaaaaaaatagtaattcttatagcttgttcctttatatttatctttattgctggaatgttggagccaattgactggtttatctatagctatgcaaaagcttatggaattcccctattagctgcctttgcaactgggtataaaaacttatttttgtatctaatttctatgctttttaaatcttgaggtgatacgattaaagtattggctatagatatatctggaaggcatcatgaaaatgatatattttttagagtttatgctggggttttagttgagattaaagcagatagaattgtgcatgtggaaaaaatagatgttatggttaaagaagaagaaactcagaagttgagagatattgttaaagaggttaaggagttaattgataaagttggagatgagtttgattacattctatgtgaaagaggagagtttttcaacatatccaaggatattatttcagcaattttaaaaaaagaggttatatttccaaagaccagaggggagttggaagcgataaatatagcccaccatgtttcttattctgttaggaaactgcttatagaagaaaaaagaaaaagttaatagaaactttatattgcctggtaaaaaataaaaagctgaaacataataagatagtttttaagaaataaactttggtgattctaatgtatgagatagttagatacgaaggaggggtttataaaaacaacatcttcaaagaatggattgaggatatcggaggttttgttattcaagagcacgttatgcagttagacgtttatatgaccttggcaattcctcaaaatgaacttgaaaatatcaaagaggaagctaaaaaatataagggtaagattatagaaaccccgttggcagggactgaaatagctgttgtggctccaagtttatcaagacatcacctcccacatactgcctgtgatatttcagaatatttgagaagatttggagctaagccaaacatgattggtttagcaagaggggttgggagagacatagcccaattgagagaaaaagaaaggagattaatagaggagcatgatttggctgtttatgtaatgggtaattttgaggattgcattaaaaataaaacccatctatttgatgtggatattccagttgttgttactggaggacctgaaaaaatagatattccttacccgtatgttggaaatcttgggagaagaagccatagattaaggcatggagaagaaattagagctttaagaaagatggttgaggtaataacagaacttataaatgagaggaggagagagttatcttacgaccctccaattgttccaccagtagttgttaaagatgagattgagaagcaggttgaagaagtttattcaattttatctccaatgcctatcgttactcaattggatggtttgagagttaagttagattatgataaatatgcagataaaattagggaagttaaagtcaaaaactatacattgggagatatagcagatattaaaagaagtgagatgaaaaactatatattaataaaaataaaaccaaaatcagaagttgaatttgagatgcataaggataaagcttaaattatttttataatttttataaataacattacgagggagaaacatggagaactttaattttaaatgctatgatatagatgaaaaggaaatcccaatacctcctggattacctcaatcaataattgccagattgatagagatttgtaatgtaaaatttgacattagggaggatgaaatatacaatgttaaatatccagtgttaataggaaaagaagaagatttaaaagaagctaaaaaatatttagagttaattactgaagcaaaattgactttaagagatattgcaagattggcgaggagatttaaagtaaaagctaagatttacacagatgatgaagatttgagatatattttagatgttttgagtaacgatatagccaataaggattatatagagattgttgaagagatgccagaaggagataaagaggttattgaaattggagacaaaaaaatatacgttggaatataaataaaattaaatgactttagccaatagagagacaatattcataacatctatttccttatctattttattctcctccttaaacctttttaagctatctcttatgtggtattcacagaatgggcaaactgtaattacagcatctacattggcatcataaatcatccttgccctacttttacctattaagttagcaatatctggttttccactcctaactcctcctccagctccacaacaccttgcctctatatcaataaattcaagttctggaatggactttaaaatctctcttggctgtttatatattttttgtcctctcctcaaatgacatgggtcgtggtaagtgattctcatctttaacggtttatactttaaaagtccaacttcagttaaaacctctgttatatctttaacttcaaactttctctccttataatcgttttttaatgtgcttccacaaccagcacagattgttacaacacaatcaacatccaacttgttaaatatttccaagttttttctttttagcatttcagcaacatccctctgcccagttctgaagaatggtgagccacagcaaacctgatttttaggaataacaactgacacaccatgagcatttaaaacctttattgcatcttttcctacattttgcagtctaaaatcaactaaacatcctgtaaagaaagctactcttaatttctcactttcagctggatagaaatcagcaacttgctttaataatggcaattcctcttcaacaacacttctgttatattttaaaacattttccctaacttttaagtgattttctatataatagcccttactaaatgctaaagctctaagcttttctatagctctatgaacaatatcaatctcctttgggcagacctcaacacacttagcacacgttgtgcagttgtagatattttcaaagtatgcagttatctctctgccatcttcgtccctcttatcaaacgcaaatctcgccaactgtctcataaaagttgggccaggatagtcgctaacttcccttgctggacatacagagaggcaagataggcagtcaatacaacctctaagctctttgttctcttcaacatatttgggaatgagaatttcaagctcttcaggataattttttcttataaggtagttttttatgcctaataactttttataatatggttccctatcaacaattaaatctctaataaccttaaatcctcttaatggctcaattatcatgccatcctctacctttgtctcacatgccaatcttggctctccatttattgttacagcacaacttccacactgagcatttctgcaagacgctctaaataaaatattagcctcataatgcttatttatatactctaaggcctctaaaactgttatattttctgggacttcatagctttcaagatactctttctctccgttaaatctcttaactgttatctttatcattatcccatcctcaaagaagctattgcaattatatatagagctaaaaataaaattccttgccatctaccaatctttgagtattttgcaaataaatagagtaaaaggctcataattaccaacacagccatttgtacattttccgctgggagatgcataaataaacttccaactgccaaagcgccaccaatatcagctatgttacttccaatgacatttcctaagaccatgcctccaaggtttctctttgctgctgctaaggaaaccattaactctggtagagatgttccaaatgccactaaggtaaatccaataaccttatcagatatatctaaagctaacgctatcttctttgctccatcaacaaataattcagctccaactaaaacaccaattaacccaattattaacaaaactaaggagaacactactgaagggttgtttttatcattattttcttctatctcagcacttccattctttacagtccatcttaagtagataataaataaaattagcaaaacaactccatcaatccatgaaaatccatcaattcctataactgcagcaaatataacaaatagaagataaactaatatattcttttgtaagtttttatcaactattattggacttataattgcacttaagccaaggactaaacctatattgcagatacaagaaccaatggcatttcctattgatatgcccggagcatgcatataagaagcataagcagatgttaatatctctggcagagatgttccaatagccataaccgtagctccaatgacaaagtttgacacattaaaatgccttgctatcctctcacttcctaagacaaaccaatcgctcccataatacagtagaataagccctaatagaaaataaccaacccctaaaattagcattcttatccctactaaattaattaaagtttgtttttgaatatattctgcaataatatttaaacttaagcaaaattttcagttcatccatattgtatttatattgtctcctttaatagataaaccctatctccctctctaactaagtgatttagcttaactccgaccctctctccttttttagcaatttcaacatctttatggtttatctgcattgatttaacaacctcctcaacacagccagtagtttttccaattattaatatggtatctccaatttttaaatcatgccatagctcaatctctgccacactaacctttttgtaaaaattaacaactcttccaatctcaatctttctatactttgatgcatttccttcaatctcatattggaagtcgtgatttttatttatatctctaaagtaaaatccagtatcatagctcctattatagaccttctgaagctcttttttgaaatattcaagcttatcataataactgccgtctaaaacgctatctattgcttccctataaatctttgtagttctcatcacataatcggcatttttagctctaccctctatcttaaatgaatcaaaaacctccattaactctgggatgtgttctatcatacataaatcctttggagataaaagatatttcccttcacaaactatctcataagtgccgtcatgatgctcattaatcaacttccactttcttctacatggttgtaggcagtctccacagtttgcatgtcttccaaataaataggagcttaaaaagcatcttccacttatagcaacacataaagcaccatgaacaaagccctcaagctctaaatctactttatccttctttaaattttctctaatctcttttatttgatttaaggttagttctcttgataatataactcttttagcaaactttgaataaaacttggctgttaaggagtttgttacgttgcattgaacacttgcatgaactctcagccctaattcattagctaactgcatagttcccaaatcactaactataactgcatcaacttcagcagaatttgcaaaatctaaaatttcctcaactttctttaaatcattttcataaacaaccgtatttgtgcagagataaacctttttattattatcgtgagcgtatttaattccttctattaactcctctcttgtaaagttttttgcatttgctctcatgtttagctctttcaatccgcaataaactgcatctgctccataatcaatagctgtttttagacatgttaaatcattagctggagataaaagctctaccataaccatcacttagaaatttttttaaattttaaattatatttgaagtataaaatagcaataaccaatatgacctcattatataaaaaagattatcctattggaacaactacaggaatccctctaacattttcaatataagcatcgactccataaactgctttaatattctctggatttataacttctctccctccttcagcatatataactccatcctttagcattataaatttatcggagtatcttaaagccaaatttaaatcatgcataactacaattgaggctatgttttgagattttgatatatccataatgattttcataacctccaactgattctttaaatctaagttgtttgttggctcatctaaaagtaatatttgaggctcttgcactaaagcccttgctattattaccttttgcagttctccaccactcaactcattcgtatatcttagagcataatcctctaagtttaaaagctttaaaaccttgtgagttatctctatatctctatcagagacttcccattttatatgtggcttccttcccaacaaaacagcatcaaatacagtcatgtaatttccttcagctctctgtggaacataaccaactttcttagctaattcaagattatctaaattctttatatcaaaattatcaatcaatattgtccctctctttggctttaagattttatttatacattttaataaggtagatttcccagctccattaactcctaaaatagaaacaacctctcctcttttaacctcaaattttatgttgtttagtatttgcctacttttatatgcaaattcaactccatcaacagagagaatcattaaactcacctataataaattatgcaagatatatagcaaaatttccaatattttaactaccatttcttctgattttataactttaattgattcatctatggatgaatcttttaaatacattaaacatcttaaacactcctcctctccttcaaactcaaagattatcttattattttcaattctctcaatgcatttataatcaattattggcttttctggaattttagtcatgaatttttcacatagctctttataaaatggaagtggagtaaaaggtagaaatgagagatatccatgtcttctaatatatcccattatatcatgatgcaaatacttccctaatttatgatagtcttctttattatccagagaatcctttaaaatcctctctaaaagttctttattgtttctcaataaaatataaattaatttaaaataatgagcaaatattaaataatttacataaccttcccagttcaaccttttttctgattcgaagataaaggttatttttacagttttttccaacattccaccccaaatatttggcaaactaataatatactattattatactcttttatacatctttaacagcaagtaaagaaacatcggagctcctaagaaagatgttaaaatcccaactggcaacactatcggagcaattattgtccttgcaaacgtatcagcaataagcaataaaacagccccaaacaatgcagagattggaattaaaaacctgtaatctcctccaatgcaaatcctaactatatgtgggcagattaaaccaacaaatccaattattcccaagaatgctacatttactgatgttaataatgaagctacaagcatgccaatcaatcttgtcctctctgtattaactcctaaggatttagctgtctcttctccagcctctaaggcattgtaatcccaccttttatacatgaaatatattaaagagggaatcataactgcagccatgatataaatctctgtccatatagctcttcccaagtctccaaaagtccaataaaccattgccgccaactgcaaatcatctgcaaagtattggatgagcatagttccagctgtaaatagagagctcatagcaactccagctaaaatcatggcctctggagttaatcccctcaacttagcaagtaataagattacaacaacaccaatcaaagcccctaagaatgcaaagattgttatcatgtatgggttgtttataaatattcttccagtgctctcagcccctccaaaaccaaacatgattatggcaaaacatgcaccaaacattgctccatgtgaaattcccatcgtaaatgggcttgccaatgggtttcttaaaatgcactgcataactgccccagctacagctaaagacattccagatattattgcggcaaatatccttggcagtctgatattccaaataactaagtttatatcatcttttccataacccattaaggcatttacaacctgattaacagttaatttatagtctcctacgcataaggcataaattgagcttaaaaataaagttataagtaaaataatcccaaaaattatcttcttttttgtatataacttatatttctgtgggatgtccatactatcacattttttgaattattttaaagctttttagcaacaatcatctttgctggtgaattatctttaaatcgaagcgaatccgaaggattcgctgacttacgaaaactcgaagagttttcgtcaagtcctaaaagttctgacatatcaacaacttccaagattttaaaacctaaatcttctaagtattttaaataatcattgagatttaaatctccttcaaatgtgtatcttattttacccttcttaagcccttctggtttagagaagttccattccatgttgtttatatagtcttcaataccctcttccttatctggaaagaattgcttatttataaataaacctccttcatttaaggcattataaaccttctctgcaatctttggattttttccacctggattatatgagcagaatattatatcgtagccctttccgatatcatccttataaaaatctccagtaattgtgaagacgttttttgcattgtattttttgataaattttttggtttcttcaataacatttggtaaatcaaagacatagcactttaaatttctgtttaacatgctaaatccaattgcatacaatccatgtcctccagccaaatcaagaagttttttggcgtttttaaactcctcatattttgccatgtaatttaaaaccttctgcaactcccagcacttgcattcatctgccattctcctaacaacctttggaaaaaagttatcaacatccatatttgagcagttggatttattttttaaaatatcagctaaattttcccaatttttaatattctcaaaatagctgtatattggattgattatgctataatttgaatcctttttcagatagatgttggttatttcagcatttttgtaataaattctttcacttacaactttactctcaattaaatctaattcattaaggatttttagcatatactccattaaaatcaaatcagcgtctaaaatctctgccaattccttagcagttttaaaactgcttaaatactcaaataaatttaaatcaatagctgtcctcaacaaataaaaaatccttgcttttgaataaacttcatcaaaaagcttcaatatcttctctgggcttttatctggagattttaaaagcattttatcaccaaaataaaaattataaaaaattaaaaattagctgctaaactctaatttcttaaatcctcccaatttctctttcatctctttataaactggctttccaaccaagaaggtaaatatctcatctgctttttgttctgggtctatatctttaaatctatctggataaactacttttcctatataataagcatcagcaagagctgttcctatatttgttgtgtagaagttatatggcaataaaccataaacatctccattcttaaatgcctttaatgagttgtaaaattctttatttctcttatagtcttcaacaactaacttcaatcctccttcatcaatgaatattatatctggattccattttagaatttgctccttagtaacaaatacatgcccctctttacccaactcatctgcaacgttctttgcattaacagcaacaaatggtggatatttgcactcagtgctgtcaattccatgcagtcctttgtatccaatacctccaacatagacacttggcttcttatcgtctggaatatcttttgttctctcatttaaatcattttggcagttctttataaattcaataacctccttagctctctcttctttgcccaatatttttcctgcaagctctaatgatttaaataaatcttcgttgttgaatgttgccaactgcccatagcttaaaacaactactggaataccagttttttgctgtaatgcatcaacttcatcctttggcatgtatgtaacaaatattacatctggtttgacctgaattatagcctctgggtttggttttggacaaggccctccttgccctattgttggtaagttagcaagctctggatgtgcaattctataaggtcttgtccatggagtccatttcttctcagtatcttcaactccaacaaccttatccgttgcgtttagatagacaataagtcttaaacatcctggaccacagcatacaatcctattaacttctttaggcacttcaacctctctaccatacaaatcaacaacttttatggtgttaggagcttcacttgcagttggagtttgtttttctatattctgctccatacatccacaaaaccctacggcaataattagaattgttaataaacctattaatttctttaacatattgtcaccattttaggctatatgatatgaacaaaaatttttaatatctaatatatatttttcggtagtttatcaaaaataatcgttaaaaatacatcaatattcataaaaattatataaaaaatagaaaaaagttatttagttaaaatctctacaacatctttaatttcagataattcagcatttaactcctctcccattaatccacatttcataatctccttattgtttggaataactgcaataaccttatctttattgacattttcaagaattaaatcttttgtctcatcatctaccttattaactatgaaataaaccttcttacccaatttctctccaatttcctctatcttcttagataatcttattgattcataggttgggtctataattgcaataataacatcacatcctccctcaacccctctaccaaaatgctctattccagcttcagtgtcaacgataacaacctctttatccttcaactttaaagattttaaaaactctcttaacaaagcacccattggacatgcacaaccttctccaaaatcatggatttttccaattgctaaaagtttgatattatctttctctactaaatactcttttggtaaagaatctatagatatctctccctcaaataactcaacttctttaccatccattttttctctcaacttcttcatgaactcctttcgtcctccaagatactctataaagtcctttggcaaatccataccaagcaatttatgcaaacttagattagattcgtctccatcaataaccaagacattatgtccttttttagcaaactcctttgccaataaagttgttatagagctttttccacagcctccctttccacagatagagattttcatacctctccctcagtctgatttaaatttaattaaaacctaatatcttatttagtataaatctttttctaacaagtggaggaacatacactggtctgaaactatgccaacagcttgattctctatctcaaagtctcttccattaatattattttatctaaaacttttgataaaatgtttgaatctattattatgccctccaattaaaattttaaaattaaaaataaagtccaaaaaataaaacttaaaataagataataaagattatgctgctggaatgattaaatctctctctccagctggctcaaactctcttagagcccctttagctatacattttcttggccacttgaagtcaaatatcaagttgtcgtcagcaaacgctaccttaattattgggtttaagcaaaatgcatctccccttgccgcatggggagcttgggcaattccagcatactctggctgatgtccaacgttcattgcgtagtttggataatttggtcctctacattcatgcaataaaccttcatcacttctgattgatagtgagttagctgctccacactggtcttgtaagtcataaccatagaatcctaatctgctgtgatactccttatgtaatatctggcttagataccatccattaattccagcatttgagtttcctgttgcaaatgctactgaacatcctgctgctgccgctgtaacccccgctctttgtgacccaccaaagtggtcttctaataaagctggatactcatcatactgctctaatccatataatgtaacttcagttgctatatctttaacaacctccatgcttggcttaactccacataatccatacttcttctcaacatagtccattccataataaacaaaatcatctaagatgtcatctgtgtatgttgctgacgcatactgtgtaaatcctactcctccagacatatagcttcctaaccaaacttggtcataaaaggtagctgctgcaccaataacctccaatgttacctgtgccgggtcatctgaaactcttgaagtctgtattatgtcagcgaatattccaaatggcacccctcctggttcattaggccctcttgctcttcttgctggcagtatcatacccatttgaatgacatcagcgtgctttgcagcgtatgagaagtcagcgatagcagcttctccagcacataacttataggcagtaatgaaactcatccctatttgcatagcactccatcttgaaacagtccctccatcacagcatctaacaactattgtaggaaccctacttacttggtaagtcctatttccaatatatttcttaatttgctctgcttgttcttctgggaattctttatttatgtctattaaaaatctcttgtcaatttcatcagctaattcatcatttcctgtgaatatcttagcgtaacagtcccaaactaaacctggatggacttcaaccatgtgctcttggacaacagctccacctggtaaagcgtggttaattgtttccatgtattcgttaattgtttctggtgtaacctctacccctaatctcttctctaagacagcgtgagctgtatccatccctacaataacagttctcttaatatcatcaaccaattgctgtattgctgcgttattacagaagtgtaaatcatccccttcaacaaatgcatcagttcctgatattttgtaggtcattaactttctctgccctaatggaaccccaatgtctgggttgtagaatggaattcctcctctcttttcaattaatttttgagcaaattcaacaaactctctttttcttgctgactgtctccatcctccaaatatataaaatttggtgtatttttcttttgggtcttcttcaaacttttcttttaaagcctttaggaagagttttttctcaacatccattattcttcacctaatctctttttcaaatcttttttaaatacttctaaaccaaatcctccttttgttcttgcctcatggattatttgaacaacttctaaagcttctttatcttctctcattccgatgttatcctttctgtaaattgttgttatttttgccaaataatcgtgtggtaatggctctccaacatctactggctcatccaatggtcttccaacctggtctttaacatacaaaacgtgtcctgtcttttcatcatagatgtatctctgcaaaccatcgaacatcaaaccgttttcatccaatcttaatgagtgcccgtggacagtagctcctctaattccacaagttgccgggtcgaagaactctgtgtcaattaagaaattcttggagattttttctaagtcaagctctctcatctcaataacttgccttcctgatagtgttcctgtatcaatccctctaaatctccacatgtatgttcttgccctatcgtaaggctgagctggagcgttatacatcgaatcagcgaactggatgtatctaactctaactccttctttagccccctgaatcggctcaacaatatctttaattgggtcttcttcaaaatccatctcttccaatggtggatgaaccgtcttataactttctccagggtttctatgccccaatattttgactatctcatcatctggaatgtctctcagcttttttaactcaacctctggattcatgtgctttcttctattctcagcaattaaagtatttccaggataaaattgtggtttgtatgccatccaatcaccattttaaattactttttctttctctttaacctctacagcaccttcagcaacatactttagtggttctcttaagtggtcaatagcactataaacagttcctactaatgctgatgttctttcaactgagaacatttgagttcctgcgtctaaacacattgcagctgcagcacatgggatagcaaatccttttgagtgtcttgtaacgacgtggtttccatggaatgttccaggccctcctcctccatatattgagtgagagaagaatgagaaaccaactgctgtcccctctgccctaccaaaatcaacgcttggcaaaccagtttcgtattctaagatatcgttgtagtagaggacagttgaagctactccttgagctgcccttgctgccccaacattaacaataactgcagcaactaaacctgacgcagcataggcattccataaagcccaatcaactggttcataaacggtgaaaccagaaggcattgtttttaatggtcttatgaccccatcctccaaagccctttcaacaactgaagcaactacagttccaactgttccatcctttccgttttccttaacaagctcataagttaagttgttggcatttaatccctgaaatgctaaacctaataagtgcaatctttcaaatgcccctaaagcatctcccgtttcaaacattgcggtctgctccaatattgatgccaaagcaacagcattcaatgtttttttccttgtaactgctacaatatggtttgccataatatttctcaaaccataacctaatccttccaataaaactggaggtcctaataatgtagcgatattagcaccatggaaatctactgtctgtgggtatctccccataactgctgtttttactacaggagcgtcaaacatatctacatcaaaggcatcaacaattgcctgaacagttgctcctcctccaatcagcgctgatactgtgtaatcagcagctactctcaacctctttgatggcaattgtaatagtaattgcttacctccgttgattaacttaacaactgtgtcatcatcttcttcaatttgaaccattcttttaatcttttcagcaataatttcagcgttttctacaattggtaaatctaactctctccctggacagaaacatgcctttcctccaacagctccagtctttaaagcgttttctattcctgccaagtttatagcaacgctcctcttaatgtcattgactattttctcaattgttgggttctttagaggacttatcgcttctaatggaacattttcctccaacaactttcctctttcatcatacaaatctattctatcttcataatgtaacattaccaacaccaacctttttgttaatatattactacagctatagaaaatgatagtaataggtatataaaattttctattttatcctaaaaattactaaaaaatgttaaaataataatattaaaatgataaaattaaaaaaatctttaaaatctttaaaaaaattttgaattcctcacagaggtgagccctattcaatagaacttacgcatttttttgaatcataaagaaagcctaaaagtatcatcaatagcaaatagagtatagcctctgcgtaagttccattgtgggagtgattcctatggcatactccatataacaaaattcatcatatataatattttcggtttaatttttaatataaaattttatcttagattaaaatattcataacataatatttgtatatttaaattaatctttaatagcaatatttttataaaacatcgttattaatactatccagaaaataaatattacatgtgatatcatggagcggatttcattaaccatcgagaaaaatctattaaaggaagttgatgaaattattaataaggaaagaatatcccgttcagaatttataagaagagctttggaatactacgtaaaaaaatacgactggttgagtagaattgaatcaaagattggtgagataaccgttatatataactcaaaggcagttgaagacatcgttaaattggaaagccaatataaggatattgtaattatatccctcgaaattccatttgaaggaaaaattattaggatgattgcgattaaagggcagagggataggataatagaatttacaaataaattgaaaggtattagtagcgttgaacttgctcaactaaccacaatcagcattgagtgaaatcatgcacaaacttgaaaagattagggaggagttaaactcatatttcttagaaagaagggaggagattgatatagccttaacttctatcttagcaaatgagcatactgtattcttaggaaatcctggagttgcaaaatcacaattaattagggctatagcttcccatataaacgccaactactttgaaaaacttataacaagattcacaaccgaagatgagttattcggccctttaagcattaaagagttaaaggataatgacagattcgttagaaaaacatctggttatctaccaactgcagaaatagcattcttagatgaagtttttaaggctaacagttcaatattaaacgctttattatcaataatcaatgaaagaatttaccacaatggagataagattgagaaagtgcctttaattagtttgtttggtgcatcaaatgaattgccagaggagaatgagttgttggcattctatgatagatttttatttaggaaagtggttagagggataagaagctgtgagaatttagtaaagctcattaaattagatgaagagtataaaccaaaaactaccatatcaataaaagaacttagaaagatgcaagaaaaagctaatgaagttgatatagagaatatcattggatatttggtagatataaagaagaaattatcccaaaaccacatctatatttcagataggagatttaaaaagtcagttaaagctattaagtgcttcgcctatctaaatggtagaagagaggcagaaattgaagatttagagatattgagacatatattttgggatgatatagatgatatcttaattgtttcaaaggtaatatttgatataacaaacaaatatgctgagcaagtgctggataaggcagaaattattaaaaatctcaaaaatgaacttaagtacatagatattaagaaaattggagagtgtaaaaaagattataacaagttaattgaaattctctgtaagatggcatatataagattagaattgaaaaaaataaggaatgaagctataataaacaaaagaaaaactgactttattgatgaggtaattaaagagacggatgaatttaataattatattgaagggattttaaatgaactgtgaagaatatagaaagaaattaaaactaaattatggaaatagagaaaaattaaaggttttgaaggaactatatcaaatggaagttgatgagataacaaagttaaacattttagatgatgtttttgagttattgacatcaacgaaggagagggggtttgaggatataatatctacacactacacttctgactcaaagaataaggctattatatattattgcataaaaattatagaaaaagttggcattaaatatccaaatttggtttatatttatattccttatttaataaaactcttagatagtgagtttgaatgcattagatttgcaagtgctgaggctttggcaaacatcccttcaaaactaacaatctatgcatatccaaaacttataaagaaattggataatgaagtttatgccaaagtgctggttaagttaatcatgaaatcagataataaggaggcaattttattaaaactttttgaaaattttaacgaatattctctctatgtgataaaagagctttataaatatgataaggagttagtttatgaatttatcccattaattttaaaagagtttggaaataatggtttatatagttttttgcaaaagtaattaaaattataaaggaaaattgaacgccttcaataagaaggcgttcattataaccttatgtatttcaagatgtttgcaaaaaactataattatgatgcaagagataaaggctgattaacaaatacattttcctcaattctgaattgttgagcatagctaactaacttaggaagagatttcatcaaattctctactatacttacagatataaagtctgggatgttatcataatcattttcagtgcttatctctccttcaatatttgcttcaaaggaaaagtctccataagctttgatattacaaacaaagttgaatttttttgcgtctaattttttatactcaatgttccaatcaacatctaactctaccgttttattcttaggtatttttattgggggctttatagatatacttaagagattaacctccatactctcaccgtgtaatacttttatacaagatagtatatatattttatgatttattttagatttagtattatggtgaaagaatgattagatatgacaaatatgataagatggtttgggagggatgtaagaataagattaccttccatttaagtgaaagagagacggagatagtgttttatctcttctttaaatatgaagttgaaattttgactgaaactgatttaatcaaaaagattgtgagggatagaagatttaagaatgtaaaatccataactacgttggatgaaaactattctttaatagccactgaattcttttgtgagaagcttaaggagttgaaagaaaagggcagagaagaggatataagtgaattgttggatgagcttgagagttatatggaaaatataacatcatcttttagttcttttggttctggtgagggatataaaagctatacagacccaaagaaaaaattagaattgactgaaaaattattaaaaaacaacaaacttaaagaatttatgaaagttttaggaaagtttaaaagaatggctataaaaaagtataaaacgaagattaaacacttctctggagagaagtattcaataaacttgggaaataatttaataaacttattatcatcagaatacaaaaactttgctgaagagatattgtttgttgatttattgagaagatataatgaaaataaacctctaaattataaaatattggagaataatgaaaactgcggggattttgttgtttgcttagatttaagtggctctatgagaggaaataaggagatttgggctaaagcaatagccttatgtttgatggatatatctttaaaaagaaataaaagatatatatcaattttatttgatgatggagttagagatataaagatttatgaaaaaaaggtatcttttgatgagattttggaatttgcatccgtgttttatggtggagggacaaactttgaaaaacctttaagagaggcgttaaagtttaatggagatattgtctttataacagatggagagtgtgaagtctctttagagttcttagagaagattaaggaggagaagcagagaaggaagataaagatttactctatctgcataaacacaaaaccaacagttagtttgaggcaaatatcagatgtatcagtaacaatttatgagctaacgtcaaaaacagcagaaaaggtgtttgatatgttgatttaacaaaagttataaatttgcaatctcatatagatttagaataaaataatcaacatagagggattgataatgaaattctttgatagggagagggagattaatgaaattttgggcattttggatgaaactccagataatatctacttcatctacggccctataaacagtgggaaaactactctaatgatggagataatcaacagattaaaagatgacaaaaaatatagaatcttctactataatctaagaggagttagaatatcatcttatagtgatttttttgatataatgtttgaaattagggaggataacaaatttaaacagatggtaaaagatgctgatgttttagttgaaggcatcaaatttatagaaaaaacagcaaaactgttcaatgagagcattattctcccttctgacttggcaaaagttattctatccaaacagaagggttttgatgtttttagatacttggagagagtttttagagagatgaataaaaagggtctaaagcctgtaattattattgacgaactgcagagattaaaaggattgaaatctaatggagagttgatagatgatttatttaatttttttgttagattgactaaggaattgcatataacgcactgtttttgtttaagctctgatagtttatttattgagtatgtttatgatagggctgaactcagagggagagctgactatatattagtggatgactttgataaggaaactgccttaaaatttatggattttttatctgaggatattttaggcaggaaactttctgaggatgagaaggagctaatttatagctatgttggtgggaagccaaaggatgtttatgatgtgattattaagctaaagcttggtaaggagttaaaggatatcttggagttcatgctcaaagaagaaatccaaaagctaaaatacttcttagaggatgttaaagaagatgatgaagagctttataacaaaatagttgatgcattgaagatatttaaagaaaattatgaaattgaagatataaaaatacctaagaatattagagagtttttagttaagaaaaatatattgtttttaaatccaatagaagggacattaaagcctcaaagttttttagtatggaatgctataaagaaattactgaatggacattaattgggactgaaagtcccaacttaatggacgagttttgatgaaacttttactaaaagtttcctttaaagcctcaaagttttttagtatggaatgctataaaaaagttattatagagctttgtttgataaagaaggggtgtttctatgaaattctttgatagagaaaaggagattgctgaaatacttcatatattaaatagagagccagatgacgtttattttatctacggccctataaatagcggtaaaactgccttaatcaatgagattattaacaataggttggacaaggataaatatgttgtgttttattttgatttaagggagatttttatttctaagtatgacgacttcattgaagttttatttgaagaatatgagggaaataaaaagccagtagaaattataaagagtttgataaaggacgttccttctctatgtggtattccagcaccaaaaaatacattagaagaaatcttgaagaaaaagacaactaaaaatgtctttagatatataactaaagtattaatggatattaaaaaagaagggaaacagccaattttaattatagatgaattacaaaagattggtgatatgaagattaatggattcttaatctatgagttgtttaattattttgtttctctaacaaagcataagcatctatgtcatgttttttgtttaagttctgatagtttgtttatagagagggtttataatgaggcgatgttagatggtagggctaagtatctattggtggatgattttgataaagaaactgccttaaagtttatggattttttagctaaagagaataacatcagcttaactaatgaagataaagagttaatctataattacgtaggagggaagccaaaggatataaaatatgttgttgaagaaagcaattttaaagatttaaaggaagttttagattacctgttaaatgatgagatttctaaattagatatgtttttagaaattttagattattcaaagccaagggtagaggttggaaatgaagttattgagataaataaagaagatatcattaaagcattaagattatttaaggataagtatgagatacctaagaaagatattccaacaccagtttatgtttacttagttaaggagaatattttatttttaaatccgcaaaagagaattttaaagcctcaaagttatttagtctggaatgctataaagagattgctataattttaatccctacttgtagctttcaatctattttcatttaacaataaatctaaagcatcatttatatctttaacaactatatcagagcttaatatcgttttactccaagctccttcatctccaataacgcagatgcctaaatcagcattttttaataatagttcatcgttatttccatttcctatagcaataatttttttgttgggattttctttttttaactcttctaaaatttttaatttagctatcttttcactgccgtatttctctctatctaccttcatacctttgacatttaagcttttagcaatatcgtttaaagttccgaagtatctgccgataaaatatatatttcagctctttcttttaaaatagttaatctctctttaactccctcttttatcttcccatcagtagctattgttccatttaaatctaaaagaataatcatggtatcagccgaatctgttttttctatttgaattaagaaaagagatataaaaatgtagccattagaatttttaatagcttagggatttttataagctccttctcttctacttatctttctaattattattattctatcatcccataaaacaacatattgaactctaaattttccaattctaactctataaacctcatcactgccttttaatcttttaatatcaaatttttcttttggaatgggattggtttttaatgtttctattagttctttaaacttctttaagtttgagggaggcaaatcctttaaatcttttaagactcttttatgtatctcaacgttaaacttcataataatcccaattctttcaaagcctcttctgctggcacagtctcttttttatccagagattttttaacatcttctataatttcttcataatcctcttcaaattcctcctctggaatagctaatgctttcaattttaataactttatttctaatttttcaatcctttcagagatttcatctctcaattttttcaattcattcaattcagtttctatttgtgctatctctttgtttatattgagcatagttatccccttatttgtcttattttaattcttaagtagtttataatataaaaactttaatctcttgttatcatcgtcccaataccctcctctgtaaatatctccaacaacaaagcatgaggaatctttccatttattatatgaacgctcttaactccatgctctaaggcatataaggcactttcagcctttggaatcatccctccctttattcttccatcttctatcatttcttttagttctgaagctgttaattttctatgcaacgtctctggattatttatatcatccattattccatcaacatctgttattaaaataagcttctccgccttcaaagctccagctatgtctccagcaacggtatcggcatttaaattatatgcctctcccttctcatccaaaccaattggtgatacaactgggatgtagccgttgtttatcaaaatctctaatagttcagtattaacctcaactgtctctccaactctacctaaatcaacctctatctcctcccctttttcagtttttattttctttaattttttcttggctaaaattatccttccagattttccagatagtccaacagcctttccaccaaactttgataactttgagacaatgtctccattaatctttccggctaaaaccatttcaacaatatctaaagtttcttcatcagtaactctcaacccatggacaaactctggtttcttccccattttttccattgctttgttgatttctggacctccaccatgaactacaactggatttattccaacatacttcaacaaaacaacatcttgagcagtccaattctttgccttctcatcaatcatcgcatgcccgccatactttatgacaaaaatcttcccataaaatttctgtatgaatggaagagcttccattaaaatctctgccttttcaatcatctctatcatgtccatccccataaaaccttttaagtttatgagtggataaaggaattatttaaaatttatcaaacaataactttaaataatagaagccgtaactaaggtaattaataaaaattaagattttagataaaacgagatttttggtagttggtgagataagatgccgaattatcatgtgactttacaagctgcatatattgtgagaaacgtagatgatgttgaagacgctataagcgtaactatatcacaaatagggaagatgttgaataaagaaggattgaactatgtagatatagacattggattaactatctgtccgaaatgtggagagttggtagattgtgttttagttgtagcaagaacagctttggttggtgttttactatctatgaaggtatttaatgctgaaagtccagaacatgctattagaatagctaaggcaacaattggaaaagttttaaaaaatattccattagagcccgttgatgttgtagagttagaaaaataaaaaaaattaattaaattttaaattaaattaaattttataattttatccttttttaaatcccagtccgaatcctattaggaaagatgtcccaaacgaaaatgaatggataagtccaataatcttatctccaaacaccaataacgaattttcaagatttccaagtaatgctgaaaacgcttccttattaatgctaataactcctattttagccaaatagagcaaagataatatataaatccctattaagaatgccactacttttatagccttttttgcagcccagccaataacaaatccaataataaatccgctacctatatctggaagaaactgtgagaagtccaaaataatcaccctatataaataacttatctaaaactaaaaagattttctttaatttggtatataaaagtttctttgtgggaagtgataattatgaagacatacattggaaagatacatttaaaatggtgtaaaaattgtaatgtcccattattagggagagtttgtgaagtttgtggctcaaaagctgaagaagtaaagctaactccaccaggagacccaagattgggatttcagtatgacatggattttataaataaaattttggaagaagaatttggagctaaaaatgtattaaatggaaaaattattttgttaaataaaattcctggtaatgaggaggcttatgagattatagttgatggagaagttaaatatctgatatattttgatgaagataaggagaaatggaaagttaagctaaagttaaatggagcaaaggatttaatggaaaaaggagcttacaaaaaaataattaaaataaagaatgatgttgtagaatttttaaaaaatagaaagggttctgttttaagacctggaatagtcgaatttacggatgatattgaagagaaagatgatgtgataatagttgatgagaatgacagagttgttggtgttggattagctgttgtttcctccgaagatataaaaaacatggagaagggaaaagtagttaaggttagattttttattaaagataatgaagattataagcctggaaagatttatgataacttagaagaggcattcgatttaatggttagagctaatgagggagttatagataattatgaaagaaatgctattggatttataaaaaatacttatgaaaaaattaaaaaacccgttatggttgcattctctggaggaaaagatagcttagttactttaattttaacattaaaggctttaggtaaagacatagatgttgtgtttatagacactggcttagaatttgaggaaacactaaaaaacgttgaagatgttgaaagacactatggtattaaaataattaggctgagaggagagaatttctgggagaaagttaaagaatacggcattccagcaagagattatagatggtgttctgaaatctgtaagttagagccgttaaaaaagtttattgaagagaattacgaagatgatgttttgtcctttgttgggattaggaagtatgagagctttaatagagctactaaaaagagaattcatagaaacacttacattaaaaagcagataaatgccctcccaatattccattggagttctctgcatgtttggatatatctgttgagagagaaagctccatacaacaaactgtatgagaagggatttgataggattggctgttttatgtgtccagctatggaaatgggagagatgaataaaataaaaagagaatttccaaaactttgggaaaagtgggaaaatgttttgagagaatatgctgaaaaacataacttaggagaggggtggataaaaaaaggtttgtggagatggaaacataaaaggcaataaactttaagctttatataatgtttctttatatggagggaaacattttataattatttccttacaaatagtgaaatttattaattatttacttaaagtgagattatgaggattggtgttgttattcatggacctgagattatagatagtggctacgcattaaaaatcataaatttactgaagaaatttggagaggttaaggcaaagttaggaggtacaatgggaagagttgctgttatagacaacaatctgcaagatattattgatatatctgaaaaattgatgccttcccaatcattaaaaaaattagctaacaatgatattttaattttaatgaactatggaaaatctaagattacagggcatacatttggaaaaatcgtagttgagagagctaatttaaataaaccaataattcagattgagagaccgggagaagaggatggaactataattatttggaatgatgataattcaaaaattgttaaagaaatagctaattatttatcaaaagaattaaatttaaagattgaaaaatgtataagtaatggcttagaggtttgggaaaaagaggggagagtttttagaaaggttcatggtgttgatgttggtgaagcaatattggtaaatggcattgttgttggaaaagctaagagtaatgaagttattttaattgctgagaatgggaagttagttgatattattggaggagagttaaaggaaggaggaattgaaaaattaaaaaatgttgatttaaaaaaggcagttataaaaaccgggattttgaggaggcatccaacaaatccaaagattgagagtaaagagattgatgaaggatatacaatcattataaatcatgctggagaggatgttatagagatgattaaaaataaaggcgttgtggcagtgattacaattggagatgatactacaacaatatgtggagatatattggcaagatttggaataaagattattggcattacagatggggatagagatgagatattaaaaaatccagttatattaaaaggttcagtaatttttctaattaaaaatatgcgggatgatgatgttggcagaatattagaaaaaaatttaaaccttaacaaaaaatactgctatcaagagcttttagatgaagttaaaaaaatatttaatgataataatatttgttatgaagaattcgtttattaaatttagccaataatgcctgaagtttttagtgagataatcagatttacaacagttaatgcaattgtgatatatagtagcattttagttgaatttatagagttaattatagattcttgagtttttgataaggatttaatgctgttgcttaaactttcaatctttttgctatgatgttttaaagtatcttccataaggttatatctattgcttattttgagtgaagattcctctaatgaatgttttatatctctcatttcatttttaacagctattattgcgttatgggtattttcaacagattttttcatattttctgcaaaatctaaatattcttttaattttttctctaattcatccaattctgaaacagatagatttattctctcatttgttattcttaatccataatgtatttcagtgatatagttgttaatttcagaaattaagttattaagctttgttataatttcatctaatacaatttctgtttctaaaacgcttgaagagctcttgtcgagttcttctattaatttattaagccaatcagcttgtttatcgttcatctttatcacctaaacgcccctccccacaaaagttattttcaatgctcatttagaaaattatcaatttgtagaaggagattctttaatttatcttttaatattttagttttttcaattaactcatctaaattttttctgttatcctctaacatgtcgtatgctattttaaattcctctatggcctgagttgctgactccatatttataattttaagtttatctgttatttcttttaatgtagggattgatgacgcacaattctcaatttcattttttaaattgttagatgtgctttcaatattttcaataactttgattaaattttctaaaggtttaacaaatttttggataatctcattattagaaaatttaccactttcacgattttttagaattatttgaaagtttttttcaataatttctaatgttttatcaatgttatccaacatttccgctaattgtaatagcacattggagatactttcattctcttttttgaattctctggcacttcttagtagtgattttatagaactatccaattttataaaaagttcatcatttctattttccatttgaaacacccgaaattcaatttttaattaagttctttacttaataattatatcatattataattacttatttttaggtatcaacatctcgctaatttttgaatagggatgactccctccctaattgatattattttatcatcctctattttaataattgtagaaggttttgaatatttgcattttccaatatcaataacataatctacttttttcaacacttctttatctatctcatccacagtagtagggctttcttttccagaaatatttgctgatgtggttgttaaaggaactatagaaagctctctaataattggttcatctgggattcttatcccaatataatctttagctacaatatctggaatacctggttttttctttaaaattatcgttaaaggtcctggaagaaatttatcaataatttttttagctaaatcatttacataagcgtatttttcaatctcattcttatctctaacacatattgatagaggcttgttgaactccctcctctttatattataaacttttcttactgctttttcatttaaagcgtttgctgaaataccatataaagtgtcagtcccacagatgacaatctttccatttaatatctctttttttaaaaattctaaaactttttttctctcctcttcattaagttcgtagatttttattatcttgttttttagtcccataggttatcccttttaagcatcataaagtattattgctccatacctacaaacttttaaacactccccacactttgtgcagttattttcatttttaacaacaactctattgttttttatagcaaaaacgttatttttacagactctataacatgataaacagtttttacatttgttataatcaatctcaattattttatttgatttctcttcaattttttctttgcctttaaatatacctaaaattttagataacattatctcacctaaaataaaaataatagcttatccaataatagcatgttttaaagcccatagggaaaccctattgggataccccaacacctcctcgcttacgctcggaggtgtaaattaaaggattttagttttataatttacccaataacagcatgtttcaaagcatctttgcagatacactttctctctccaaagccataatttataaagtcctcaacaactttcaaaattttattttccatctcttttattttttccaaaacttcatcaactgttaaaatattttttgatattccacaggcatagtttgttatgttgcatagagagacatagcacatctccaactcccttgctaaaacaacttcaggatatccagtcattcctacaacatccccccagtttttgtatatggctatctctttttttgtttcaaatctcggtccttcagtgcaaacataaacgccttctccataagagaagttatttttatctaatattgattttaaaatatttctcaactctggacagtaagggtctgtcatatctatatgaacaacttttccttcatcgtaaaacgtctcttctctcttctttgtaaattctataaaatcatttggaacaaaaaacattccaggctttaaatcttcttttaatgaaccaactgaatttatagccaatattctttcaactcccaacttttttaaagcgtagatgttagccctatagtttattttatgtggtgggatgttatgtcttactccatgcctaaataacaaaactacttcgttttctttatcaattataactcttgctttcccatattttgtatttataatctcttctttgtctccttttaatatttcagctattcctgtccctcctattataccaatcacactatcaccaaaaataacatgattaaaaataaataaactaagttttatttaataactttaaaataattttctatgttttatttaaaacccatctgataaaaattttaatggatataatagatatcctgaaaaataaaaatagattaaagttataatgcctcttttccttcttcttttgttcttactcttacgactctttctactggtatgacgaagatttttccatctcctgggtttcctgttcttgcattctcgcatatgatatcaataacattatcaacatcttcctcttttacaaccaactcaatcttaacctttggaattaaatcaacaatatactctctccccctatacctctcaactattccaccttgaactcccctacccttaacctcactaacagtcattccaacatacccagcatcagacaaagcctttttaacaatctccaacttctccggtcttatgattgcttcaacttttttcataatctcaacctcatttttataattttacaaatttggtggtttttagattaatttgaatttggtagtaatcatttttatttttatctaaaaggaaaaaagattctttattcctaaataataggaaggaaaattctttccttagtaagttatatatttaagcttttccattaggggaattaggaagatgggtagtaggtaagataattcctataaaagtgtttgaggtgaaacatatggatggtattgatgttttcttttttatgtgggcagcatcgttaatatttttcatgaaggcagggtttattgcgttggaaatagggcagtttagggctaaaaacgtctcatatcattgtgttttaaagttgttggatttagctgcagtgtttatcgcttatttgttcattggttatggtatctcttacggatttgaaaatataatgcccttaataacaggaacttttgatgctgatttgggagcttggtggatgaagatggttatgtttgccgctgctgcagttacaattataacaggaggagtcgctgaaagaattaaaatcttaccttactttataggggctttgattgttggaggtattttgtatccaattgttgaacatttagtttggggaggaggttttgctaatttaggaataaacttccacgactatgctggaagtggggcagttcatttatttggtggtttagttggtttaatggctgcctatgttttagggccaagaattgataaatatataaatggaaaaccacaggcaattccagggcataacattccaatagctgttttaggagcttttattttggcatttggatggtacggattcaacattggaagtgcttctggcatagctaatggagtagagttggcaagcgtagctatggcaacaacaatggctttagctggaggaattatagggggagcattaagctcaagaaacgaccctctttacacagcaaacggtatgtgtgctggtttagtagctgtttgtagtggagttgatttattcactccaattggagcgtttatagttggtttattagcagggattcagcagccatttacatacaagtttattgaagagaaattaaagattgatgacgtctgtgctatagggccagttcatgctatgagtggtttgattggagttatctgtgcaggaattccattcttattaaaagctgatgcagtgtctaaagtttcaattactgggcaaataattggggctattgttattgctttaattgcaatcgttggaggattaattatttataaagggttggatttaacaattggcttaagagtcagtgaagaagcagagaaagttggtttagatactgcaatattgcaaacaactgcatattcagaagaataaacttaataattttttattacgcatattcctttttttaatctccaattattttcctcgataaaatatttatatgatttttagattttaaatattcagccaaaaagataattttatattgtgataacatggaacttatgatggctattggttaccttggattagctttagttcttggttcgttagtggcaaaaattgctgaaaagttaaaaattccagatataccgttattgttattgttaggtttaatcatagggccttttttacaaatcatcccatcagattcagcaatggagatttttgaatatgcgggaccgataggattaatatttattttgttgggaggagcatttacaatgaggatttcactacttaagagagttataaaaacagtagtgaggttagatacaataacatttttaattactctacttatttctggttttatttttaatatggtcttaaatcttccatatacatccccagttggctatttatttggagcaataactgctgctacagacccagcaactttaattccagtgttttcaagagttagaacaaatcctgaagtagctataacgttagaggcggagagtatctttaacgacccattgggaatagtttcaaccagtgttattttggggttgtttggtttattttcctcatcaaatccattaattgatttaattacacttgctggtggagccatagttgttggcttattgttagctaaaatatatgaaaaaattattatacattgtgacttccatgagtatgtggctccattagttcttggaggagcaatgctccttttatatgtgggagatgatttattgccaagtatttgtggttatggatttagtggttatatggctgttgcaataatgggactttacttgggagatgcattatttagagcggatgatatagattataaatatatagtatcgttctgtgatgatttatctttgttggcaagagtgtttatttttgtatttttgggagcatgtataaagctaagcatgttagaaaattatttcattccaggtttgttagtagctcttggctctatattcttagcaagacctcttggggtcttcttgggtttgataggttcaaaacattcatttaaagaaaaactctattttgccttagagggaccaagaggtgttgttcctgccgctttagctgtaactgttggtatagaaatattgaaaaatgctgataagattccagcatctataacaaaatatattactccaacagatattgcaggaacaataatcattggaacatttatgacaattttattgagtgttatcttagaggcatcatgggctggaatgttggctttgaagttgttgggagagtataaaccaaagtataaagaagaatcccaccattaaaattattaaaattttttggtgaaattgatgattattgagggagaagtagtttcaggacttggagaagggagatattttttatccctccctccttacaaagagatatttaagaagattcttggctttgaaccttatgaggggacattaaatttaaaattagatagagaatttgatataaacaaatttaaatatattgaaacagaggattttgaatttaatgggaaaagattttttggagttaaggttttaccaataaaaatattaataggtaataaaaaaatagatggggcgatagttgtgccgaaaaaaacatatcatagtagtgagattatagagataattgccccaatgaaacttagggagcaatttaatttaaaggatggagatgttataaaaatactaattaagggagataaagatgaataatgtagaaaaagccatagaagcattaaaaaaaggagaaataattttagtttatgactcagatgagagagaaggagaaacggacatggttgttgcctcccaatttataactccagagcatataaggataatgaggaaagacgctggaggattgatttgcacagctttacatccggatatatgcaataaattaggaattccattcatggttgatatattagaatttgcatctcaaaaatttaaagtattgagggagctttatccaaatgacattccttatgatgaaaaatcatctttctcaattacaataaaccacagaaagacatttactggaattacagataatgatagggcatttacaataaaaaaattggctgaattggttaaagaaggaagatttaatgactttggaaaggaatttagaagtcctggacatgtaactctattgagggcagcagaaggtttagttaaaaataggcaaggacacactgaaatgactgtagctttggcagagctggccaatttagtgcctataaccacaatatgtgaaatgatgggcgatgatggaaatgctatgagcaaaaatgaaacaaaaagatatgctgaaaaacataatttaatttatttaagtggagaggagataattaactattatttggataaatatttaaaagattaaaggttagagactaattatttttatttcttttatttttttgattttttgtaatttttatcattttaatgggagatgtaaatggatagacatgtaatggaggcattaggaaaggcaagagttgttgttgaaaatggcagagttgttgaagttacagaaccaaaaataaaatactgcccattgtttgctaagcatagaggaataaaggagataacaaaagagagcataaaagaaaacatagaatttaggataaaggattttgggctatttacaaaaaatagagttgttgaagaaagtagatatatagttccttttggagcttcagagattttaatgagtgctttaaagagaaaagctatagatgttgctgttatagtggctgattgtgctgggactattataacttcaaatccaaatttagttcaaggtctctgtgggagaatctctggaataatagagacctctcccattttagaggttatagaaaagattgaaaaagctggaggggttgttttaaataaaaaaactgctgaaataaatcagtttgaaggtgttaaaaaagctattgagttggattataaaaaaatagctgttactgtaacaaacttagaagatgctaaaagatgcaaatcattagaaaatgatgagataaagatattaacatttggtgttcatttaactggaattgagggaagtgaagaaatagccaaatactttgatttagtaactgcatgtgcatcaaaggttttaagggaaaaattaaaaggcaagataaaagcacagattggaaaaactataccgatatttgcattatctgattttggaaaagagattttattggagagagctaaagatttagataaggtattaataagtattgagaacttgccagtattaaatgataatcagccaaagcccttgatttagaaaaatttttttaacagatattgttacaaaactaaaaacaataactgctatatatcagcatttttaataacatatttatacccagacatgggattaagttttaatggtgaaaacatgattatcttcggattatttggaaaaacaggatgtggaaagacagaaatattaaatgaattaaagaaacatcatcctgtaatagatattgaagaaattgcaagaacaagagggagtattttaggggatttatatcacttaagtatgagaagccaggaagagtttgactatctaataaataaagaaattgaaaaggctaaaaaatttggttatgcagtggttgaatatgagggaaggaagattggtggagagaaaaagctaaaaattcctgagttgttggctgatattaaaaactatacttacaaaatcttaattgactgtccttatgaatgccagataaacagattagtctccatttataagccaaaaaatgaaaaagagaaagaaattttgataaacaaatttttaatattaaaggagagttttaaaaagccagagatgattgaagcagttgataacatcattgaactcataaaacaagacaaatactatgaagcagcaaaattaattgaagaaaaactttatagagaacattatatgagaaatgtgaaaaagataaagccagatttaattgtttataatgaggatgttaaaaaatcagctaaaataattgatgaatttattaagaaaaaattaaaggagcataatttaatttaagagggaaaacatggacgagggaattttagctcggctaataacctttacagaggatgttgttttatgtattgttttaaatgatgggaggaagatgataactaatggtaaaaaaatattggctggaaaaattgaaggagagcttgcttcttttatattatctgcctctaaagaatttttagaagataaaaaggtcggtgtaaaaaaatttaaagattacgacatatactttgaaagaatagatatcaacaagtttttaaaatccattgggggagaatttgttaaaaatacaataactgttagtgagttgttagagttgataaaaaaagaggatgttattattgtagatacaagaagtccaagagaatttaaggaggaaacactccctggagctataaacattccactatttttggatgatgagcatgcattaattggaaagacctacaagcaggaaagtagagaaaaagctatagaaatagcaacagatattgttgagaaaagcttaaaaagaattttaaatgaagcaaaaaaacttgatagggataagttaattgttgttttctgtgcaagaggagggatgaggagtcaaacaatggctttaattttacaactattgggttttaaagttaaaagattaataggtggctttaaagcgtttaagcatgcagtagataaataaaaaatttaaatttataaaagttttaaatgtcctgttattttatctattttctcatctttctcagggcctatggctacagctgtcaaagttcctggctctaattgtgtatgtcctgcatctctaatgattgagcacggcaatccttcacttcttgctttgttgtaaatatctatcaactctttttcagaatttactttaaccactacctttttctgtccttctctcaaccattcatcaacagcccttggatttttccttttagcatctaagaaagcctctattattgcatgtcctccctgagctaccatctttccctttcccatacctaaatcgttccttattactacaaccatcttcataattaaacctcaaataaatgtttagtatattgtattatatttatacctaagaacgcattaaatacttataaatttaatcatgatgtttatcaactaaaaaaattaaaggatgagaaacatgcaggaaaaaggtgttagtgagaaagaaattttagaggaattgaaaaaatataggagtttggatttaaagtatgaagatggaaatattttcggttcaatgtgttccaatgtattaccaataacaagaaaaattgtagatatcttcttagaaacaaacttgggagaccctggactatttaaagggactaaattgttagaagaaaaagctgtggctttattgggttctttgttaaataacaaagatgcctatggacatatagttagtggagggactgaagccaacttaatggctttaagatgcataaaaaatatatggagggaaaaaaggagaaagggcttatcaaaaaatgaacatccaaagattatcgttccaataactgcccatttctcattcgaaaaaggaagagaaatgatggacttagagtatatctatgccccaattaaagaagattatacaatagatgagaaattcgttaaagatgccgtagaggattatgatgtagatggcattataggaattgctggaacaacagagcttggaactattgacaacatagaggagctaagtaaaatagcaaaagaaaacaacatttatatccatgtagatgcggcatttggaggcttagtaattccatttttagatgataaatataagaaaaaaggagtaaattataaatttgacttttctttgggagttgattctataaccatagacccccataaaatggggcactgcccaatcccaagtggagggattctatttaaagatataggttataaaagatatttggatgttgatgccccttatttaactgaaacaagacaggcaacaatcttaggaacaagggttggattcggaggagcctgcacttatgcagttttaagatatttaggtagagagggacagcgaaaaattgttaatgaatgtatggaaaacaccctttatctttacaaaaaattgaaggaaaataattttaaaccagtcattgaaccaatattaaatattgttgcaattgaagatgaagattataaagaagtctgcaaaaaacttagagatagaggcatttacgtttcagtttgcaattgtgttaaagctttgagaatcgttgttatgccacatattaagagggagcatatagataattttatcgaaatattgaatagtattaaaagggattgattgaaaagattgaaattgaaaaagtatttatatcttaataaaataataaatatattaataatttatgtatattaataatttatgcttttagttattataaattgttatttttggttatatctacatatatctattaatctcaatataatgttatacagtatatattatttggcatataccttgtaacttaaaaatttaagatgggggaggggtatggacgaaacttggagaaaaattgctattaaaaatatagcagaaattaatcaaaaaataaccaggttagagtggctcttaaattcgtataaaaatgaagaggagataaaacatatcaataaaaagataaatgagctaaaaattaaaagagaagagtatatgaaagctcttagagagtaagattatttatttgttatttatttggtaatatttatatttattatttattacagcatttagctacgtatatatgttataaaaattgaaaacttttcaaaacttaaggttggagatgtcagcgtaatctttaaatatctattttcaatatctctatgggtagggtatttttatcatcttaactattttggaggtgttgatgatggaagagagaatatacacaatcccattgagagatgttataaacaaatcagttagaacaaaaagagctccaagagctataaagaagataaaacagtttttaaagagacacatgaaagctgagattgttaaaattgacaatgagttaaatgaaaagatttgggagagaggtattcaaaaaccaccagcaagagttagagttaaggcagttaaagaaggaaatgttgttatagctacacttgcagagtaagggatgaccatgattataagaaaatacttctcaggaattcccacaattggtgtattggcattaacaactgaagaaataactctattaccaatttttcttgacaaagatgatgttaatgaagtatctgaggttttagaaacaaaatgcctccaaactaatattggaggcagttcattagttggttctttatcagtagcaaataaatatgggctattactaccaaaaatagttgaagatgaagaattagatagaataaaaaatttcctaaaagaaaataatttagatttaaatgttgagattataaaatcaaaaaacacggctttaggtaacttaatattaacaaatgacaaaggagctttaatatctcctgaactaaaagattttaagaaggatattgaagattccttaaatgttgaggttgagattggcactattgctgaacttccaaccgttggaagtaatgccgttgtaacaaacaaaggctgtttgacccatcctttagtggaagatgatgaacttgaattcttaaaaagcttgttcaaagtggaatatattggtaaaggaacagcaaataaaggaaccacttcagttggagcttgcattatagcaaactccaaaggagctgtagttggtggagacacaacagggcctgagcttttaatcattgaagatgctttaggcctgatttaataacttattttcaattttgttgtttggttaatggattgtcttgttgaatatgtttgaaatttgaaaataagagtatttagaagttattaattagttcaaaggatttttatttaatttctaagggtttgctggtttgattgtttaaaatatttaacttaattaaattatttggatttttgaaaattaagattaattaggtaagtaaataagatttctctaacaaataagttaaatttttgaatttaggaagataaaaatgcttagttttagtaaagagataaaattttaaatactaaaaggtttatattgtaagatggttatttacccttagaaaaatatggtatagaaaagcttaaatattaagagtgatgaagtatattatgttgtgaatgattgccctgttaaaatcagaccgtttcggaatggaaatccagttgttatgctgggggtaatggaggtttttggcgttagttaaaatcagaccgtttcggaatggaaatttatctgttattgatacttttcccttttcccaaataattgttaaaatcagacctcttggaggatggaaatagataagattgaaggcattaaaacagtatttactgaagattaaaatcagacctcttagagaatggatagaggatggaaacggatgagtattatatttcaatgcttttaatttataagataattaaaatcagaccgtttcggaatgggattctgttttaattaaaatcagcttattgttattttgtttttatctttatcaatatatttgaatataacaattaatattttataaaaagtatttaatagcaaaaataacagaaattaaaaattgaataaaaatggtggtatcatggaaattatatttagaggagcggcgttagaagttggaagaagttgtatagaaataaaaactgataaaagcaaaatactattagattgtggggttaagcttggaaaagaaatagaatatcctatattggacaactccataagagatgttgataaagtttttatctcacatgcccatttagaccattcaggggctttaccagtcctatttcataggaagatggatgttccagtaattacaacagaattatcaaaaaaattaattaaggttttattaaaagatatggtaaaaatagctgaaacagaaaataaaaaaatcccctacaacaaccatgatgtaaaagaagctataaggcatacaatcccattaaattacaacgataaaaaatactacaaagatttttcctatgaattgtttagtgctgggcatattccaggaagtgcatccatattattaaattaccaaaataacaaaaccatcttatacactggggatgtaaagttgagggacacaagattaaccaaaggagctgatttaagctatacaaaggatgatattgatatcttaattatagaatcaacttatggaaacagcatacacccagatagaaaagccgtagagttgagttttatagaaaagataaaagagattttatttaggggaggagttgctttaattccggtctttgctgttgatagagctcaggaaatattattaattttaaatgactacaacatagatgctccaatttacttagatggaatggctgtagaagttacaaagttaatgctaaactataaacatatgctaaatgaatcgtctcaattagaaaaagctctaaaaaatgttaaaataattgaaaaatcagaggacaggattaaagcaatcgaaaacttatcaaaaaatggaggaattgttgtaacaactgcaggaatgttagatggagggcctatactgtattatctaaaattattcatgcataatcctaaaaatgccttattattaactggttaccaagttagagactccaatggaagacatttaattgaaactggaaagatatttattggaaaagatgaaattaagccaaacttagaagtttgcatgtataacttctcatgccacgctgggatggatgagctacatgagataattaaaaaagtcaatcctgagctattaattatacaacatggagaggaagttcaggcaacaattttaagaaactgggcgttagaacatggatttgatgcaataactccaaaattaggagaaaaaataagaatctaaagataaagaggaagagatatgttgggattaaagattgaagatgctataaaatacaatgaaaaattaaaaaagtatgtttataaaaaaggagataagcttagaattaactttaaagacaaagaggcgttaatagaatataacaaaacagttttgaaagttttatttgatttggatatagaatttcataaaaatggattaatccctacaccaataaacagatatctctttataaaatccacttttgaaactttaaaggagcttggtatagaaaaaccaactgttttagagattgggactgggcactctgccataatctccttattaataaaaaaattttataatgctgaagtttatgccactgaggttgatgaagaatttatagattttgctaaaagaaacatagagaaaaataagttagatataaagattataaactctaagggtagagctattgaaggcattgaagagcttaaagataaaaaattcgatttaattatttcttatcctcctttctattcaaaaaattcagtagcaagtggaagaaagtttgggggggctttagctaaaaatgttgagctaattggtggaggaaaatttggagaggaattttcatttaaaataattgaggagggaatcaactttttaaataaaaaaggagttatctctttaatgatgccaaagaaaccagaaaaaagaagagagcttataattaaaaagatgaaagaagttggattagatgttgaggttgatgaaattaaaactggaaataggttgagatatattattaagggaataaaagggtgagatatttgaatttaaaagatactgtcttacttggaaggaattttaatgaatatgtaaggatgtttaatttaaatgaagatttattaagcaacaaaatcttagatgttgcctctggagttagctctttttgtgcagaagggaataaaaaaggctataacattacatcttcagataaaatttataatctaaaaccagaggaaattgaagaaaaatgtaaaaaagacttggattttatggaaaaacatttaagagggatgtttaaaaacaactttaactggaatgaatttaaaacagttgatgaatggaagaaaacaagagaaagaacttacaaaacatttattgaggattataaaacaaataggaaaagatatatctacacaacttatccaaaaacgaattttaaagatgatgaatttgctatttctcttgtagggcattttttgttgttgtatgataatatcctcaactatcaattccataaagaaacaattgatgagcttttaaggatttctgaagaaattagaatattcccaatattaaatttaagaggggagaaatcaatatttttggacaagattttaaaggaatataaagcaaggattgaaaagacagattatgaatttatgaaaggaggaaataaagtcttaattataaggaggtaatattatgctaaccatattaaaattaggagggagtattttatcagataaaaatgttccatactcaataaaatgggacaacttggagagaatagcaatggagataaaaaacgccttggattattataaaaaccaaaataaagagataaaattaatactcgtccatggaggaggagcttttggtcatccagtagctaaaaaatacttaaaaattgaagatggcaaaaaaatatttataaacatggagaaaggattttgggaaattcaaagagcaatgagaagatttaacaacatcattatagacactctacagagctatgacatcccagctgtttctatacaaccatcttcgtttgtcgtttttggggataagttaatttttgatacctctgctataaaagagatgcttaaaaggaatttagttccagttattcatggagatattgtaattgatgataaaaacggctatagaataatttctggagatgacatagttccatatttggcaaatgaattaaaagctgatttaattctctatgctacagatgttgatggtgttttaatagataataagccaataaagaggattgataaaaataatatctataaaattttgaattatttaagtggttctaatagtatagatgttactggtggaatgaagtataagatagacatgattaggaaaaataagtgtagaggttttgtatttaatggaaataaagctaataatatatacaaagctttattgggggaggttgaaggaacagaaattgatttttcagaataagtttttattgctttaaccatctatctaatgttacctcctccctataccactctactttttgaggtttaaaggatatttttccatattctcctccaccaccaggatagatgtatatttttcccttcctaaatagattaattgtctctgctacttttggatgtatttttgaaagctcatcaatatcagcatttatcaaaacctcaatctcatttccatactttttaataaactcctcccataagctttgaacagcctttgtaaatatccctttaccaatagttaggctaatcatctcagccaatggaattagcttataatagggaggtctaaattttggatgctctatctttccatcactcagctcttcaactctacttaaaactcctttctttatacttcctccacactttgggcatttccaattatatttcttagcatcttctaacttaaaccttgtgtggcatttagagcaagcagttaaatgatacttccccaattttgggtctaatccatagttagctataattttattatgttttattgccttttttatttgttcaaagttatcttcaattccgccaatataatcaacctctatttgattaaattctcttcccaatctatgaggatgatatgaatgggcatctgaatttgataaaaatggcaaatctcttagctcaggaatcatgtctgccatatcagtatctgctgacaaaccaagctctacaaagtcaggttttttgttatagcagtcatatattgaatcaaaagatttatagagggatgtccatggagtaaagcagttatgtaaagttcctgaaacagttacatagcttgaatcatcttcaacctccaagttatatacaaatccatcataatactccctccctattcttataattggagcatataggtaatttcctttaatccatccatatctaacatctttttttggaagcttaatatcttcgttttttaactcatctacaattttttcatccaatattgatactctcccctgccatcttgcatggtatttaataacttctctatctccaatttttggattttttggaacatgtttgctaaatgttattataaaacctaatcttaaagaaatcaatcttaactgattcattaaaatctctgaagttgttacacctttatctcctctccaccatccaataaatatttgaagttgtttattcttaggaagatataaaaactcattaggtaaagctttattccaagctcttttttcgtctccacaataaaacatgtctccaaagaaatctcttaaaactcttgagtaatattttaattctattccttcacttcttccatcatctcttattttcggttttaagttgaatattttcttcatcaaatattctatatcatcaatgatttttttctcattttctcctaatgcaaatcctatcccatctctaaagcaataaccttcagataagaaatatccaactaatctacaaaactcttcagaaacttcaattttttctgggattctacttctacagaactctcttttaatattgctaagatacttatctaatgacagatatttaatgtctctcactctattcggtattggatagacaatcacatcgcccacttttaaatccttagctataatccattctctcttatattttctatacctctttttacatgaaggatttgtatattgagttaagcagttgaatttacaaattccatgagagccgtcacatctcttttctgttttaattgcataaaccggatgttcaggagttaatattatctcctctgggaagtatctaactttaatctttattatgtctccaatatatcttcttttataaactttttcaacttttttaaacctattttcatgagttaataccttatctcctacttttatatcgactattcttttaaagccattttctaatatcagcagtgtatctggaggaacgcaatgagcaggacctattaagccaccaacgtctctaacaatctctaaaagctcagctccaccaatagatactcttggccttccctctttatcaatatccttagagtatttttttaaaatctctctaagctcttctactttgcttattgaaggcaataagataaggtgatgaactctgtttttatcttcaatttcagtagttaaaattagctctctatctttgtattgctttatctcttctaaataatctggatgtgtgcagtcgccagttccaataatgtttaatccctttagttttccatattttaggatgttctctacattcatatcctttgatgttccaccagagaatcttgaatggatgtgcaaatcaacattagctatcattgtatcaccattatggttaatttttaatgcttaattttccttacttttaaaacttgttttttagagtaatgtatatttatttaaatatacaaattattatgtcatgttaggtaatacctaattttaataagatacaaaaaagataccgaaaagtttatatattagataacctaaggtattatctgagaatgaaaaggtaatgaaaaggtaaagttaggtgataccttatgaatgtgaaatgtccagaatgtggggcatggatatatgttgttgaagaagatagtgggggagacgctatggaagtaaaatgccctaaatgtgggacttcaatatacgtagtaaaacctatgggtgagaaaatgaaaaataaaagagataaagattttttagatgtaaaaatacttgaaatagaggaaacaaagaaaacttcaccatataaagatacaaaatctgaggatgtattaaaagcccttagagtaaaagcaaacataaatggagaaatatatgaattcagaatatggcaaattgctaaaaaaccagaatatagaggaatggtatatgtagttaaatccgtatctcactattgtggtagtgtcaaaactaaaaatttccaagttgatgaagataacgatatatacgtaaagcaaaaatttggtattattgagggagttaataaaagtaaaataaagctaccaaaagaaagaatggaagagatagcagaaaaattaggatttgagcttaaagagggagatgaaggactaaggttatacttaggagagaaatattcagaaaatccaccattatcacaaagaccggagttaattgaaaagcttataaagtgttggattgcattttgggagccaacaatgatttaaaacttacttaatttttaatattaactatattatgaactatcatggctagtataataaataagcaaataataagtccaacggggagaaacatggagattataaattatgaaatattaaaaaaatatcctctctgtgatagatgctttggaaggttgtatgctaagttattacatacaacaaacactgaaagaggtagggcgttaaagctatataaagctttggaacttgaggcaaagataaaaaaagctaaggaaaaaggaataaattatgaagaagaattagagttattaaaagctttggcaaaaagtggagttgatgaaataagattggaagatatagagatagagaaagagaactgcccatggtgtagaggcatttttaacaaacaaaaaatggaaaagttgttaaataaagccattgaacttttaaaagaatatgattttgatacatttttaattggaactcacataccagaagagattaaagaccttgagaaagagattgaaacagaatttatggagagtataaagcaggaatttggtagagaatttgggaagatgttggcagttaggttagataaagccccagataaagaatatccagatattgttgtgcatataaatccatacactgaagaaatctatctacaaataaatcctttatttattaaaggaagatatagaaaattagttagggggattccacaaacaagatggccttgcagaaagtgtagaggaaaaggttgtgagctctgcaactacacaggtaaaaaatatccaatatcagttgaagaaattattgccaaaccattcttagaggcaacaaaaggagtagatgcaaaattccatggagctgggagagaagatattgatgtaagaatgcttggagatggaagaccatttgttttagagattaaagagccaaagataagaaaaattgatttaaataaaattgctgaggaaattaataaggatggtagagtagaggttttaaacttagagtttggtgttaggaaggataaagttatatttaaaaacactccacatagaaaaacatatagggctttagttgaatgctctgataaaattactgatgaagaactaaaactccttgaaaaagaacttgaaaatagaactatctatcaaaaaacaccaaaaagggttttacatagaagagctgatttagagagaatccgtaaggtatataaagttaaaaccagtaaagtagatgacaatcattttgagatgattatatattgtgatggtggattatatataaaagagctaatcagtggagatgatgggagaacaaacccatcagtctcatctatattaaataaaaactgtatctgtaaggaattagatgttttgaaaatacacgataacaaccttttagaaaaaggttgatcaaaacagatgcattaagttgcctctttcagaggcaattaatgcctcatttaaaaacctattcaaaaaggtgagaattatggttcaaatgagtgaaggatttagaagaaaaacaagaaagaagttatcaaaacacccaagagaaagaggtctctatccaataacaagagctttgagagagtttaaagaaggagagtatgtccatatagttatagatccatcagtccataagggaatgccacacccaagatttcatggaagaacagggattgttgttggtaagcagggaagagcatttattgttaaagtaagagatggaggaaaatacaaacaaatcattgcttacccacagcatttaagacctgctactgcataaatatttaatttcataaaaatctctattaattaaacactttaattatttttccttgatttaaatacaactccagaaataaattattaaattatatttttattgtatcaagctaagagggagagaatgataggcaaaaaaatccttggagagaggtatgtaacagtatcagaggctgctgaaattatgtataatagagcccaaattggagagttatcttacgaacagggatgtgctttagattatttacaaaagtttgccaaattagataaagaagaggcaaaaaaattggttgaagagttaatatctttaggaatagatgaaaaaacagcagttaaaatagctgatatattacctgaagatttagatgatttgagagcaatatattacaaaagagaattgccagaaaatgctgaggaaatcttagaaatcgttaggaaatatatttaatttttttattactcctttaaatttgtaaatttaaatgaaacttttagaaaaagttaaatgaaaactctccgagttttcatagcccgaagctaatgcttcggtttcatcaaaacctaacacctcctcgctacgctcggaggtgtaaattaagtccagggtgtttattgctccgatatattcgtagatttaaatgaagggtgaaattttatggttagagggcaatataaaaaaggaaacgatgaaagaatgagatttcctaaaaaaaataagccacaaaaatttgaaaactacgcatgggttttggattatttaccttacggttatcccgacaaacctgatgaacctatagttcaagggcttggagaatatcagtttttattaatggagatgattccaaaaccaaatgtagatattgaattaggtgaaagagtctatattggaaaaggtaagagagataaaatagaccacgttagaagaatgattaaatatgaacaactaactccaacagctaaatcagaacttttatatgtagtaatggaagccgttaaaatacaggaggataggtttgtgagattctttaatgaatgcccaccaataaccacaagattacataccttagaattacttccagaaattaaaaagaaatatatgtggaaaattattgaagagagagaagcaaaaaaatttgaaagttttaaggactttgaagagagaattgggaaaaatcctgtgagaattatagctaaaagaattgaaaaagagctttcagatgacaaaaaagataaatactacttatttgtaaaatggaagaaaggaataatattgaatgaggataatatgacattctatctaaaagaatagtcataaatgtgttttagcaaactctctcaaatctctaagagtcccaaaatttagcagaccaatatcagttattgctataacctctgcctctaagtaactcttctttataattttggatgatgcagagttattgattaaatcattcccaggagataaagggttaaaagcgggtaaaacaatatagttcttgtttaataaataggtaggaaattttagaatagcaccaacatcatctctaagttttattgaaggatgttcatgccctaaaatccaaaacttctcttttaataaatctctatctatttttatctctttatccccatgaaagattaaataattaccaagttcaaaataatcaaagatttcgtagccagcagatgatataaaagtatcatgatttcctttaattaaaataacattaatatattctctcaaaaactcaataaactcttttaaaaacttaatctccttgggatatggcttaaagttgtgctttatatccccattgattattaaattgttaattttatatttatcgattatattcaaagtcctctttataacctcatctttctgcaataatgggaagttagctcccccttcaccaaaaaagacatcaaatcctatatgtgtgtcagctattattgcataatccttataaactaaacatctatcaaccgttatataaaaatctttaattttaagtctctcctccataaaatcacttaattgaggttttataaacttaaaaataaaagagaaaaatagaagaaagctttatgcttgttcgaccaacaatcttgctgtttctggtgtgtatctccaatctgctggtaacacaccttttgacttgtagtatttgactaatcttctaatctttgattcaattaactgcaaacctctctttgagtgcaagtcttttgggtgctgttctaagtgttttcttaaattgacagctcttctcattaagttcaataaatcctctggaacttttggatataagccgtgttctttcataatcttactgatttttttaccagtaattaacttaacatctggaattccgtaggtatctctcaatatcaaaccaatctgtgctgactggtaacctttcttagctaactctactactaactgctctacttgctccggtgtgtattggacccattcaggaacttccttcctgacgggtctctttgaaccggagcgacctctttttcttgcgtgcattcttgccattctatcacccgatggtcgccagtccaaagagacctggcatgttttttatttccatagggcttcgccctattgggatactagactacagtggggctgaacgtagtgaagccccactcgggtatctcaataggggtttccctatgggtctgaagagacctggcatgtttttgttatttttattttatcgatatggtaatctttttattgtatgagctattaaaaatatatccgcttttaatgaacattcacaaaagacctatttataatttttggtgagtatcatgttattaaaagtagaggatttacatgtttatagagggaacagagagattttaaaaggtgtaaatttaactgtagaggaaaatgagattcatgcaattatagggccgaatggagcgggaaaatcaaccttagcttatacaataatgggaatttccggatataaaccaactaagggaaggattatatttaaaggtgttgatataattgataaaaatattactgaaagggcgaggatgggaatgactttagcttggcaggaacctgcaagatttgaggggattaaagttaaaaactacttaatgcttggaatgaatgaaaagtataagaaagataaagaaatagcagaggaaaaaattagggaagctttaaaattggtaaatttagacccagacaaatatttagatagatatgtggatgaaacactaagtggaggagagcgaaagaggatagagttagcttcaattatctgtatggagccggatttggctatcttagatgagccagatagtgggatagatattgtatcatttgatgagattaagagagtttttgactatttaaaggataaaggatgttctttattagttattacacacagagaggagttagctgaacatgccgatagagtctctttaatctgtgctggagaggttataaagagtggagacccaaaggaagttggagagttttataaaaaagagtgtggaaaatgctataagaaagtgccagatggaaaatagtcctacaaaataatttacacctccgagcgaagcgaggaggtgttataggtatcgcaataggagtttctcctatgctgaggaaaatgctacaaaaaagtcccagaggagagggaataaaattaaaatcccagagggagagaaatgagcatcaaagaggaattaatggaaataattgaagcaattaaatatacgtctgaaaaacctgaagagattgttcatggtaaaggaccaagaatcattgttaaagagagtaggattattgatgttcaaggagatgaaggaataatattagaagggaaggaagaggatggaaagataaaggcaaagattattgttaaaaaaggctataaatttaaatacccaattcacatgtgctttggaatcactgaggaaaatatatctcaaatcatagatgttgaaatcatcttagaggaggatagctcaatctctctaatgtctcactgctcatttccaaaaggtaaaggaattaagcatattatgaacggcattataaagattggtaagaatgcaaagttctcctataatgaattccactaccatggaatggatggagatattttagttaagccaactgtaaaagttgagattgatgaaggtggcatctatatatcaaacttcacattaactaagggaaggatagggactttggatatagaacaggagattattgccaaaaaagatgcaataattgatataaccacaagaacatacgctataaaggaggatgttgttaaggttaatgaagttgttaagttgaatggagaaaatgctaaatgcattataaagagtagaggagcggcgatggataactcaaaaatatccctaaagttaaagattgaaggaaacgctccatacagcaaaggacatattgattgtgctgaaatagttaaaggaaatgctgaggttgaatcaatcccaatagttgttgttagagatgataaagcaagaataacccatgaggcggcaattggaagtgttgataaaaagcagttagagacgttgatggctaagggattggatgaggatgaggcaactgaaataattgttaagggaatgataggggatttataaaaatatttggcgatgatgacaatttcgctatctgattctgtgatgactactcccgcagctgagccaaaccattattttaaagattttttagatattcatcaacatcgtagtgtctttcaaaattaataaaaatttactaaggaaggtttgaacgcccttccttcggaaggcgttcatttatacctcagttattccaagaagttttgaaagacactataatccaacttttcaaaccacatcttttttccttttataataatatttcctctccactcttcctttgtttctggaaagtcttccctataatgtgctcctctactctcctttctatataaagcagattttgtaaccaacttagcaacaacaaccatgtttttcaattcaaagtagttctgcaagtcaataattccattaactttgacattatctatatttctctcaatttcatcaattttttctaaggctttttttaatccatcctcatttctaataatggatacataatcccacataacctttctcaaatcttcaattaaattatagacgtttaaatctcctttcaagctatttatctcctccaatattttggcaacatcttcttcagcatcaatattattaaaatcatgattttcaacaaactctttggcagattttccagcaatagctccaaagacctgggtatctgctaaagcgttccctcctaatctattagctccatgaactccccctgtaacctctccacatgcaaataatccaattatattggtttcacatctttcattaatctttaaacctcccataaaatgatgagcagtcggagaaacaatcatcggctcctttctaatatcaattcctactctcaaaaattgctttaacatagtttctaacttcttttcaataacctcattaggcaaatgagaaacgtctaaataaactcctccattaactcctctaccttcttgaatctctttatatatagctcttgcaacaacatcccttgtcgatagctccattctctccttgtcgtatcttaccatgaatctctctttatatttattgtataaaattcctccttctcctctcacggcctctgtaactaaaattccagtcccaaccattccagttggatggaattgaaccatctccatgtctataagttcagctccttcattataagctatagcaaaaccatctccagtcttttgtattggattggatgttattggatatagttgcccagctcctccagttgccaatatagttgctttagcaaatattggaaatatattcccagtctttaaatctaaaaatatcgctccatagcatctgttatctttaacaatcaactttattgccataacctcctctaaaatcttaatcctttcaaattttgagatatattccattaaacctctcattatttcatgtcctgttctatctccacagtagcaagttctattaaaactctgccctccaaatggtctttgagctataaagccatcttcagtcctatcaaacaaagctccaaacctttctaagttcaaaagctctttaggagcatttttaactaaaatctctaccagctttggattgtttataaatccccctccttttactgtgtcataaaaatgcttcttaaagctatcttttggattaaatactgcgttataacctccttcagccataactgtgcatccactctttccaaacaatcccttaacagctattatgacattcttatctctgcattctattgccgcccttgcagcagctcctcctccgcctataattaagatatcagttttcattttttatcaccaaaaataggataccctcatcagatatttaaaacttataaatcaaaatagctttgatgaaaaaaataatcctaaatgaaaaaattggcatagtataaataaaaaaagaacaagaaaatagtaatatttttaataaggcactggtaatcctaattctttcctatgctctatttccttcacatgaaccttttagtaaaaggttcatcaaaacggatgcactgcctcgctacgctcggcagtgcctcttagtatggaataggtagtccgagctcttttctatgttcgatttctttcatgtttttctctttcttttgcagtgctaatttctcaactaatcctaatcctggtttaacttcttctattggtttaacttctaaatacccatcttcaaccattttgttaaatatttcttctcccttagcagttcttataaatacagtgctccatccgtctgggcttccaactgaacctgttgaaatatctgccaactctgcggtataatctgtacaaacatggcaagcgatttgttcataaggatgagtttcttttaatttaatcgcttttgtctctccccatcttgtatagacccagaacttaccctttccaatatccatcttgacgacatcctccatcttaactccacagtgttcttcaacaatcaacttcaatccgtagtatgggaagttctccatacagaagattccgattattaaagcaatcttatctggaacgtgtctaaatcctactggatatttcatcaactttcttacagctctaacttggcaaggtgttccaacaactccaattttttcacagccatattctctaacagcactctttaatactgaaatgtttgggcagactgtatattttgttccagctgcctctaaaacttcttctggtgttgtagctactttaggaactgccttaaactccccagcgttgtctgcaactataactccatctaataaattattttctaatccataaataaaagctgttgaaacgattcccccatcctgagccttctttaaaacttcttttaatgtactccttgctgagacaacttttttatagctaccaaaaggattcatcctattccacctcaaaaaattatattatattattttattctattttctcaattaactctgggaatctaattcttggacactggacagagcaagctccacacttaatacagagttctttcaagacatttggccttccatctaacatttctatagctcttgttggacaagcagcagcacaagttccacatcccatgcaaagggatttattgacaactttgtagataacatcacatccgcaagcttcacttcctttttctgccaattcagcataaggttgtagatactccatatctccgtttaatgctgctgtaattactcccacgattgcctctggtgaaggtgggcatccaggaattgctaaatctactttaatgacttcagttaatggagagaatgagctatgaacaggctttgataattggtttcctttacagtatcttgtaacccctcctgttgcagcacatgctcctaaggcaacaacaatttttgccttctttctaacttcttgagctacttccaatgagtggtggtcatctaaacagacagagccttcaactaaagcaatatcgcattcaggaatttctcttgcatctgctaaagtttgacaataaaccaactcaattgaattcaaaacatctaaaagcttttcatatgtgtctgctaaagacactaagcaaccgcaacaactgcataattgaacatgagcaactttaaccactttaatcacctctcaactctctaagaattatctcaactgccttatcaacggctttttcaacctcttcactcaacccaatataaacatctggctcagaaatatacttggcttgacagccgacaactttaacctctatattatatttttcagcaacttcccttaataaaggagctaaaggccagtcatgagaatctaatctatgatattttggatttggaagctcatccttctcaattatttttatttctcctggttttattccccaatcaattacatcaacaacaattattttttttgttttagagttttcatctattaatgttaaaacttgctgaggggctccagctccagcatcaactaaggcaattttttgtttttctttgtcagttaagattttgtttaatttttcaatgacatgaacgctaaagccatcatcggcaaatagtatattaccacaagctaagaccataatctctttttttaaatatgaaggggttaaatcaaacaattcatcatcttggctttctatctctgccttcatggtttcattcattttaagttttttaagggtttaatttaagcttccaaagaaacaggactttcgcagtttatatatgcactttggaactttgacatctttggatgtctatattccattgaatatttattcctgcgaaagtcctgttatgcctctcgggtccctttcgggttcccctcgaggcttataacatttttctaacttctataatctcttttgtctcttcatctttaactataacgtgtgttgcacatgaagctcatatatcataagctctcattatgacttcagcatactgctgtggatagccttcaattgccttttcaacaattgggaagttccatgttgatgccgctataattctatagctcttaatttttccatcctttccaacttctgccatgtgtgtgtttgtagctcttggagcttcatgaacccctattccaaagccatctttatattctacctcagctcttgtttttccgtttaagtcgagttcatctaaaatctctaaagctctataaacagctccaaggttctcttgagctcttgctatatttatatccattgcacttcctccttctctgaaattaccaaacttgaccattcttgctcttggccctccttcagcaggaactccagcatataaaggaatttggattgttgttgtttgtttagcttcttcatcatcgtagtatctttgggctggaatttcagttacatcatcccagtttattgcatatctgtctccgtatgttgtgtgagttgctatatatggatattcatgagctcctaagtctgggattccaatctcttctaagtatctttcaattaattcagtgtatttctcatacaactcataggcatctttttcatactgtcttaatgcatagtatagtcttgatttagctctctctgttatgtttgttctcattccaccaattacaatgtttggtgggtggattccttctcctcctacaatatctacaactaattgtccaacctttctcattctttggattaattttattagttcaatttttaaatctgtctcatctggttttaagaagtcgtcaattgtcaataggtggtgtaatgggtgggagtgcaatctatttccaattcctactaactcccttaatagcaaaccatcatctggaacttcacagtcaatagcgttttctatagcttcacaggaggcaattccgtgtgtggtttgacagattccacagattctcatcactgctattggagcaaactctgctggcttgccctttaacattgtttcgaatcctctaactggggttgtgtttaaatagtatgctttatttacaattccctcctcatcaacctctaaaattaatttggcgtgtccttcatgcctggttgtaggggcaatttctattctattggtcacaaaattcacctccaaagtaataaaacattgaaaagagatatttgtttaatcaactatcattaggttgttttatataagcttatataagctaatatctctttaaaaatgccaatatagggatttaggtttttggatatgttaaaaatcaattttttgtattattaatcgaataaaatattataaatagatattaccatactctaaaaagatttaaataaatgtaacgctaagagtatttatttggcagatgatgacgtttatccccgtctgagttatgatgagtagcaagccggctgatgccacttttcctttttttatttatcaactaataaagaaaagtcataaaaaacttcttttattctaattagaggggctaaaaatggacgagatgaaagtaattgaaataatcaaaaaaactctaaagttttctaatgaaaatattgtaaaaggcattgatgatgactgtgcaattataaaaattgatgaaaatttttatttagttgctacaacagacatgatggttaaaaaagcccatatcccttctatattatccccatatgaaattggagggagaattttaaccgccaatgtttcagatattgcatctatgggagccaagccattggcatttttagtatcgatatccctatctaaggaagaagcaaatgagaagtttattaaagagctttattctggcttagatgatttttctaagctttatgactgcccagtggttggtggggatacaaataggggagatgagctcatattatcaggaactgcctttggaataactgacaatcctatatataggagagggaaagttggggatgatatctgtgtaactaatgatttaggtagggtttattgtgctttaactctatattatatgcttaaagagaacaaaattagctacaaagagtttgaaagactctgccagaaatatccaaagattattgaaaaattaagaaaacctattgcaaggattaaagaagggctattaatgaataaactcataaatggttgttgtgacatctcagacggtttgggaaaggaaattacttatttcaaaaattttgagatatacagtgataggatttttaagcttattccagaagatgtcattgaattttgtgatgcctttaatttaaaccccataaaagttgctctaaatagtggagaggagtttgagcttttattcacaacatctaaatttaataaagtgaaagattcactaaaaggctattcaaagatttataaaatcggtaaaattatagaagatgggcagtttattgatggagaggaattttatggtggaggatacattcacaaatggtaaattgagtaaaaaagaaaaaattttgtttttgataaagttttatattatatttttagtagtgttttttattttaagctattttggaaaatatttaataggaattgttacatatctaagctacatatttacaaaaataattatttcagatgcaagattggcagataattttatatatttgccaaacaacactgttgaagtggttgaagaatgcacaggaagttttttaattgctggacttttagctctaattattgtttattcaaaaaacattaaagagtttataattggaatcttttttgtattgttagcattttttgtaaatatttttaggattgtattgatttgctatttggtaaatatgcatccggagagttcttatctatatcatgaaattgcgggatatggggttatattaacgttagttccagtattggttataggttatttaaaaattattgaaaaatatagacactcatcaaataaatcccacttataaataggaagtaatataaaagccctttgggcttttatcaataccttattaaataataaagtttgatgattgtctataaaggggagaaaatgcaatttataagagttaatactctaaagattaatccagaagtattgaaaaaaagattagaaaataaaggtgttgttttagaaaaaactttcttagattatgcttttgaagtaaagaaatctcctttctcaattggttctactccagagtatttgtttggctattatatgcctcaatcaatatcttcaatgattccgccgattgttttaaatccaagagaagatgattttatcttagatatgtgtgccgctccaggagggaaaacaactcatttagcccaattaatgaaaaataaagggacaatagttgcagttgaaattagcaaaacaagaacaaaggcattaaaatcaaatataaataggatgggagttttaaacactattataataaatgcagatatgagaaaatataaagattacttattaaaaaatgagatattttttgataagattttattagatgccccatgctcaggaaatattattaaagataaaaacagaaacgtctcagaggaagacataaaatactgctctttaaggcagaaggagttgatagatataggtatagatttattaaaaaaagatggagagttagtttattcaacctgctcaatggaagttgaagaaaatgaggaagtgataaaatatattctacaaaaaagaaatgatgttgagttaataattataaaagcaaatgaatttaaaggaattaatataaaagagggatatataaaaggaactttaagagtttttccaccaaatgaaccattttttattgcaaaattgagaaaaatataattggtgatgagatggattttattgttattgatggaagttacttagaaggaggagggcagattataagaactgctgtttctttatcagctttaactcaaaaaccagtaaaaattattaacataaggaaaaagagaaagaataaaggtttagctcctcaacatgtatctgcagttaaagcagtaaaaaagctttgcaatgctgaagtttttggattaaacgttggctcagaagaattaacttttataccttcaaaattatctccaaaggattttacaattgatattggaactgctgggagcatatctttggttatacaaactctcctcccattatcattaggaattaacaaaaaattcactgtaaaaataaagggagggactgatgtcaaaagagccccaccaattgattatgtaaaaaatgtaaccttaaaaattcttagaaattttggagtattgacagagctaaaagttttaaaaagaggattttatccagaaggcggaggagaggttatttttgaagtaaagccttcaaaaattaaaaaatttgatttaatagaacattctaaaagtaacttagttgaaggaattagctatgtgcaaaatttagatgagagtatagcaagaagaatgagaaaaaaggcagttgatttattaaacaaagaaaaacttctgcccaatataaaaatagaatgttcaaagggtatttctactggagcagggatagttttatggaacgatactttagggggaagttgtttaggagagaaagggttaagggcggagattgttgctgaaagggcggttaatgagttattaaaggagagggaaagtgggatggctttagataaatatatgggagaccaaataatcccattcttagcttttggtaaaggaatagtgggggtttcagagataaccaatcatacaaaaacaaacatgtgggttgttaaacactttttggatgtagattttgagattaaagaatataaagaaaataattgcaatggatttactattgaggtggtttaaatgtttaattattttgaaactactgctgatttgggtgttgaagcaaaaggaaagagtttagaagaggcatttaaagaaggagctaagggactttacaatattatggtagatattgataaagttgataaaaaagaaaaaatagagtttgaaataacaggagaagatttggaagagctcttatacaattttctaaatgagttacttttttatactgatgttgaaaatctggtttttaatgacttcgatgtaaaaattgaaaaaaatgataatggctacaggttaaaatgtactgcttacggagaaaagataaacaaagaaaaacataatataaaagaggaggttaaagcagtaacctatcataaaatggaaattaaacaagaagaagatggatggaagattagatatatagttgatttatgagccatagagggatgaaaaataaaatatacaatataattatattttctatctaaaaattaaaagtttcccaataatctcaggagcatacatagctaaaattataactaaattaattattatcatatccctcctaactaattttatttctctttcaattttttgatttaataattcaatttttttccccaatctttcttctaccaataaaatatcttcttttgtagccaattcgttccttaactcatctctaacttcatttttaataatagttttattttctttgataatctcaataattgcattatacaattcctctgcgaaacttttcaaaaaagtttcatcaaaacatgatgcattatctcgcttcgctcgataatcagatgaaatccttatggatttcattactcacctcactatgttcggtgatgcctcttagcttttctcatatttatcctcttttccgtattcagtatttcattaatcttttatctttaacatttttatgaataatctcatacaacttagcataggcaactgtcataatacccctacattcttcaagattacttttttgtgttcattgttaatgtttaattattttttattccatatataacttcctaaaacctcccctttcatatttataattatacagctgaattttatacccttccatctttcacttaacctttcaacaactcttttagctataaaattgaacacatcatttaaaactcctttttcctctaaaattttaataacttcctctgttgtatttgaatataaaattttttttatcgcctctttgtcatcaataaatagagacgaataagctgctaatatctcatttctacaatcagctacctttgaatgagtattatatatcccccccgccaacttaattatttttccagcatgtccaaagattaaaatctcctcaacacctttttctttagctttatcaagcataaatccccaaaagtttgaaacctcaataatctcatcatcattagcatttaaaagttgtttagcatatttagttccaatatttccaggaacaaaaattaatctcttatagccatttgctaatgcaacatctatttgtggagctaaagagttcatatatgcttcatttgacattggtctaacaattccagttgttcccaatatagataatccaccaacaattccaagttttggatttagtgtttttttagcaagttcttttccttttgggatagagattgttacctctacaacttcatcatcatttaacaattttaaaaggttgtttctaatcatctctcttggttttggatttatagctggctctcctttctttacctgcaagccattctttgtaactattccaaccccttctccacctttgataataacatccttttttcctttttttaactccacttcagtaataatttcaattccgtttgttatatctatatcccctccagcatctttaataaccactgctttagctttatttccacatttttcaattttttctattggaataattaatttatcaccatttaaattctcaatctcaacataactaagtttttttccaaattttaaataatataatgcagaataagccccagcagcagcacatgagccagtagtgtagccaaattttgattttttcctgaaatcataaatcataatctcccattatctttttatagttttttgcaaaacattttgagtattaatgaagaaatgaacgcctttggcgttcaaataaccttagtaattttaataacttttgcaaaaaactatcttcttctcctaaactttagttttttagttattaatgggattctctctacttctaaagcatcagctgtagggtagagttctgagatataagctgagaatgttataggaaacctctgccttttcatctcttcaataatatcctctaatataaatggatttaagcatatatttttatcaataatttcaaactctatctcattctcttccaaaatctcagccatttcctttaaatcatcctcattgtcaaaaatcataatgcctctcaatagtaagccatcttcagttataacctcataaggcttagctacattcttagctctatttattaatctatttctcatctgtatggcatcttttaaaactgatgggcagtagttaatgaataaatcacctttaaattcttttataacttttaaagctgtttcttcactgccagcaattgcattacttacatcatcctttggcataaaacctctcttctctaattcatgataattttcctcagaaaactcaagctcattgatattcataaatttggctattccatcaattgcctcagctaactttaaaatttcattttccatatttgggattgctggaatttcaaccccaacatcttcaatgtatttgttgcataagttcaatttattacataaaaactttatatattcttcatcatatccttcattgaatatttttgttggatgtagccttatctcatctaaatctgcctcttttagaagttttaagttctcttcatttactgtttccggagttgtatatagatgagcatgaaattcatcaaactctttttttagtgcttttaagaattttacagttctatttatttttaataaaggattacctcctgttattcctactcccttactactgcagagctttgcctcttctatagcctcttcaacggtagttattaacctctcattggcatatattacatctttattctttctcttttcagataaaggacagtagtagcagttgttattacaaattcctgtgatgaataaaactaattttccccctttaacacactgcttacatccctctggcaatttatcaaaattttcttccaaatatttttcaatctcttcaacattcatgttttcaccgtaaatattgaatagtaatttattattggatagatgaagccaaaagcttcaaagttccttaatatatttaaattgcattcaacctgttaaactttcctttaaagattttattcctgcgaagtcctattgaggtaagtatatatacttaaagctacttaatatatttatggcggatgatgaacggagtagctgctgagctatgatgattgatgggcgaactgacgccactttttattttgcaaatattaatttatatatttaaatataaaaatttatatgatagctatctttttataatttttataccctaatctataacaatctctaagaatcagtttttaaggtggaacgatgaatgttggagatgttataagggtagagacagacaaagggatttttgaaggtatcttattgccatcaactaacgaaaatatcattacaataaagatgaaaaacggttataacgttggaatattaaaagaaaatgtaaaaaatattgagattattgctaaaggagaaaagccaaagtatgaactacctccattaaacattgaaaaaaatgaaaaattaaaaacaatctctattttatccactggagggacagtagcttcaaaggttgattataaaacaggagctgttcatccttcttttacagcagatgatttaattagggctgtaccagagcttttagacattgccaacataaaaggaagggctgtaatgaacatattaagcgaaaatatgaaaccagagtattggagaaagattgctgaagagataaaaaaagagatagaagagggagctgatggaattgttattgcccatggaacagacactatgagctatacagcttcagctctctcatttatggttaaagctgatgtcccaataattttggttggagctcagagaagtagtgacagaccttcatcagatgctgctctaaacttaataagtgctgttttagctgcaagagaaccaattaaaggagtttatgtagtaatgcatggggagagtggagatacattttgctatctacataagggagttaaagttaggaaatgccattcatcaagaagagatgcatttaaatctataaattcaattccagtagctaagataaacccatttacaaaggaaatcatctatttgcaggaagttgaaaaatcagataacagcaaaaaggtagagataaacacaaacttagaagaaaaagtggctttaataaaagtatatcctggaatggatggggaaattattagattctatgttgataaagagtataaagggattgtcttagaagggacgggtttaggtcatgccccagagtatatatttgaacacataaagtatgcaactgataaaggagtagttgttgtaatgactactcaaacaatcaatggaagagtaaatatgaacgtctattcaaatggaagagaattacaaaaattaggagttattggttgtgaagatatgcctccagaagttgcattggttaaattaatgtatctcttaggaaattatgagccagaggaagttaaaaaattaattaataagaatttggttggggagattgaatataggagcagatttgatgcatactaataataacaaattaatttggtgataacatggagattaactatgaaaaagttggtttaaaggttgggttagaaattcatcaacagttaaatacaaagagaaagttattctgccactgtccaacaattttaagagatgatgaaccagatggagagattgttagagttttaagaccttcattaagtgaaatgggagaagttgatagagctgctttaatagaggcaaggaaagggaagaaattcatttatcaattttataatgacacaacatgtttggttgagttggatgaagaacctccacatccaccaagtgaagaggctttaaggatagcgttagaggttgctttattgatgaatatgaacgtggttgatgttgcatacacaatgagaaagatagttattgacggttcaaacacttctggatttcaaagaaccatatttttagcaagagatggatatatagaaacatctgagggaaaagtaggaataacaagcttatgtttagaggaagatgctgcaagaaagatagaagatagaggggatgcagttgtttataacttagataggttgggaattccattggttgagatttcaacagctcccgacataaagactccaaagatggctaaagaggcagcaagaagaattggagagatattaagagccactggaaaggttaagagaggtttagggactataaggcaggatataaacatatcaattaaagatggagcaagaatagaggttaagggagttcaagacttagatttaattgaaaaggttgtagagaatgaagttataaggcaactaaacttattaaagattagagatgaattaagagaaagaaatgcagaggttgttgagaagatatttgatgttacagagatatttaaagactgtaaatcaaaaattatacaaaatgctttaaagaaaaagaatggaaaggttaaggcagttttattaaaaggatttgctggtttagttggaaaagagattcagccaggaagaagattaggaactgaattttcagatagggccaaggttatagctggcgttggagggcttttccacactgatgagttgccaaaatatggtattacagaggaggaagttaaaaaacttaaagagtttgttaatgcagaagaaaatgatgctgtaattattgttgcagatgaggaaagcaaggtagatagggcgttagaggctgtaatagagagggctaaagaggcattaataggagttccagaggaaacaagaagggctttagaggatggaaatactgcatatctaagaccgctacctggagccgcaagaatgtatcctgaaaccgatatcccaccaataattataaagaaggagtttattgaggagattagagctaatctgccagaacttccagaggagaagtttgagaggtttaagaaagaatataaattaaatgatgaattagctaaaaagatggttttaagttattacgttgatttatttgaagatctatgtaagaaatttaagaatgttaagccggttttaattgctacaaccttagaagggacattgaaggagattaaaagagaaggatatgatattgataagttggaggatagacatttagaagagacctttaaagctctatctgaaggtaagatagctaaagagggaattgttgaggttttaaaaggcttttgtgagtttccagataaaagtatagatgagattttagaaattaaaggattaaaaggattatctaaggaagaagttgaaaagattattgagggcataattaaagaacatttaaatgtggttaaagaaaaaggagaaaaggcctatggatttttaatgggtagatgtatggcaaagctaagaggaaaagcggatggaaagttagttaatgatatattgagaaaaaagttaaaggagatttaactccatttcttataattactctttttgattactaacttcttatagtattttccatttacataagacttttttacaattatttttccttttcctgaaattttagtaatatgcaactcaccaatttctgaatttttaatagtaagttttccatttctaatttcattaatagataattttgttatattaactttattaagcgtcatatctgaaccccaatcaggtaatgaattaatctttaactgatatatgagggtatttttaataaatgcacttccagaatttgatacaccttcaatattcacaactgacaaacttgaatcttcaatttctaatcccttattgttcccaataattcctgttgatattgaatttccaattacattatcaacatataattttcctccgccagcaatatttccaatactaacatctataagcccactaaatcctttaagatcaattcttgaattgatattgccttctacaaacaacttttcaactttgcccccatatccaacaaatatcttcccgtttgttccggtagaaccgtgtattgtaatttcttttattatacttccatctttaacttcaatgtcacttccacctaattggtctgtttctaaggaatttataattgaactatcctctactaatatttttgggctgccaattaatttatttattttcatattgtttattgttgaatttgaaagctcaaatgttgggcttcctatcatattgtttattatcatatttccaatatttacgtttttaaactttacatttcctccacttacaatatcccctaatttcattgtagatattcgtccattttcaaatactgtctctgcccctcctccaaagttaccactattagtttcaaatgtatttatagcaaagtccttaaattttactttagctcctccagttatcttttcaacataaaatctattaatatttgtattacccacagtaagtgaaacacttcctccaatttgagattctccgctatttttgtcccttattatgaattcctgtatatacggaacatatacttttaagcttccgctaccagttaaatatgtctggaatttatttatacataataaattacctaatttgtaattagcactaccttctaaatatatatctccataaacttctccaatagcattttcttcaacacatttactatttatagttttagaaatgtctccagaaacatctttagcatctccagatactattaaatctttcgttattagaccttttgaacttcctgaaactcttatataaagataccctccaccagtttcattatttgagttgttcgattctgtattattattacctaaatttgatattgtagtattttcaactgttaaattaaatttcgattcatttatgaacaatcccatagtttcttttttaacttctaatggtttatctccaataaatattggacttttttctactaatcccatagtaataacaattccaacaactgtcatacctaaaattaataaaatgaattctaatgtgagttgcccttttctttttttgaaaatcattatacaccacctaattacccatatatcaaattttaaaagttaatagttatatatgcttttttctttccaaataatatataaatatttagataaatattattattaagttttttaaatatttttaaatatattaacttaatttatatctatatattatctatatattagttttattaaatataaaatttttattatctttcgagactgtcaagttaatgattttacccaattgtagaacatcatgaagcttttaatccagctaataactgtatcgaatttactattattaggaaacctattaaagaatgcttttgttcttcgtttaagcactgagaagaagctttctacacaatttcttagtccgaatttaactttttcgaattctaagcctaattttcgcaacgcccacggataccactttccaccgtcaactaaaatctttggcttattcgagcaaaattttaatatactcttaacgaataatatagtatcgaggtaatttcttgtcttcgatatataaactcctaagcattctttcgtttctacatcgatggcagaccatgcataaatatatttgtctccaacctttagtttaatctcatcgattgcaattaagtttctttcctttctttctggctcgtttaaaacttctttaatcttgtgataataaattctaaccgattcgtggcttatgtcttcgaattgggaaaggaataaacttaccttccttaacgataatccgaggtaatacaaaagccctgctaagattttaacctctatcgatttcctattccttttaaaaagcttcctctctacgattttctcctttataacttctattgtgagcctcatattttattattttttatcaatattttgataaaaacttaacttgacagtctctcccatcaaatagataaatatataaactcttaactttaatatatcgataaaaaatagtggaggtgatagcgttatcaaaaaatcaaaaattccgagagttaagcgtttaataaagcttatgcgagctaagttttatccgatagttgcaaagtataaatcaccctatatccttagagagataatctctctaatcgacttaataatcttttcggttttatgcatgatatattttgcaggagtgtataaatgtggatatgagtttttaattgaatatttacaattattagacgaaatcactttgtgatttcgttgctcttcgcttcgctccgattcccaaaatgttgttcatcgatgcaatgccaattaaaacaaaagagcttgtgaggaaaactcgacatgagaggataggaatttcaaagcttattaaaaaaacagtagtattggttacaatccatcgaaaaaatgttggtattttggatataaagcaactttcattaccgatgggaagtatttaatgttactgtttataaatccagcaaatcagcacgataaggatattttagaggaaaattataaagaaatcattagggacttcaaaaactgtgtaataatcggagataagggctatattgataaaggtctccaaaatctatttaaactcggaggcgtttatttcatcccaataaaaagaaaaaacatgataaaaccgaatgaagaagctaaaaaatataaagagctgaataaattaagaaaggcaatcgaaacaaacttatccaaattggcagagtcattcccaaggcacatccgagctgtaagcaagaaaggtttaagtgctaagcttttactcttcacaatcgcttacaacatacaacataaaagaatcaataaatgaataaaaacatttaaatgtgtaatgagaactacggtttgtttattatgatatgctactataagttatagaaaattaaaaactgtttcgaaccctgctgattggttacaactatcaacaaataacccatctttttaaattcaattaatgcctctctaacgttaggcagtaattcaaattcctctatttttttaacatagtctccaattagtcgtttattaataactccatccctatctaaaaaaattgccttattcaacatcatcaccaaacaatccatccaaactaactgttgcagtcccaacctttccaacaacaattgaacttgccttatttgccaatttaatcgcatcaactaaatcatacccttccgaaactgttatatattagatagacaaatataggcattgatgattatggagcgacattatactttaaaagaggcatcgaaaatcttgggagtttcgattaaaacgttgcaacgatgggataaagcagggaagattaaatgtatcagaaccttaggaggaaaaagaagagttccagaaagtgagataaaacgaatcttaggaattaaggataaagaacaaagaaaaattatcggctatgcaagagtttcatttaacgcgcaaaaagatgatttagagaggcaaatacaactaataaaatcctatgcagaggaaaacggttgggatatacaaatactgaaagatattggtagcggtttaaacgaaaagaggaaaaattacaaaaaacttttaaaaatggttatgaatcgaaaggttgagaaggtaataattgcctatccagatagattaacgagatttggctttgaaacgttaaaggaattctttaaatcttacggaacggaaattgtaatcataaataaaaagcataagacaccacaggaagagttagtagaagacttaataacaatcgtttctcactttgctggaaaactttacggaatgcattctcataagtataaaaagcttacaaaaacagttaaagaaatcgtaagggaggaggatgccaaagaaaaagaataaactcccaaccgaaattgtattgacttataaggttaaacacaaccacgatttaaaaaacttacctgatgagtttataaaaatctctcaaagagctatcgatattatttgggaaaacatcaactggaaggaaaaggtagttaaacatcgatacaaaataggaaagaagaaatacaaatattacacaactactcgactaatccctaaaattccaaaggacaatgatttcaaaagagagttgagaaatcgtttattagagggctgggagtttgcctctcactatgtcgatggagctattaagacagcttattcagcaatagagagttggaaatcaaactatttaaacgttaatagaaagaaaaataaaccgatattcaaaagaccttttgttagagttaaaactaccttgatgaaatacgatagaaagaatgggattataagaattacaataaaaccgagaaagagtatttaattttaaacattaaagatgagtggtttttcgaaagagttaaaaaattttaacattggagaagttattttaaagaataacgaggcattaataacctttaaaaaaccgttaaatttattagataaaaaggttgttattggtgttgatagtaatctaaagtcgttagatttgtatcatccagaagagggctggattagagtagatttgtctgaattacattgaattaagagagtttatgataccatacccgataagctaaaatctatctataaaaaagctccgaagagaattggtaaattattgaaaaaatactggaataggagaaaaaaccgagtcgaagattttattaacaagctaacttctcagttgtctaaactctttccagatgcgattttcatctttgaagatttagataaattcaacatgtatgataagaattcgaattttaataggaatttggatagaactaactggagaaaaatagcgaaaaagttggagtataagagtgttgtcctatacgttaatcctcactatacttcaaaaacctgccccgtatgtgggagtaaaatgaagtcccaagaggggcaggttgtaaaatgcgataagtgtggaatttttgatagacagtttgtcagatgctataatatttttaaaagaggagttgaattagctaaaaaactcttaggcggagttggagttcccgtggctggggctgaggtcgatgatttactctccaatgaacccagaggggagttgagactggtgaagcccaatcccaacgtggaagcgaagcttccagtaaggaaatcgaaccgaaggttcgagctacaaaatccgaaggattttgttcaaatctttgatttccctctgatggtctatacagttgatttaaatggaaagtacctcaaaatctataattgtccatgaatgaccacgttgggaagaccccttatttaatatataagcacacaatgtaaatcccaaattctttggtgtttcttcctctttaatatctttaatattccttccttttaattttaatgctaaataaggtacatctggacatcctccaccagagatattgactatatttccctctttatcaatagttattttcatatttccacatctgaccaatataaagccatctacctctttaacttttattaattcaagaggttttaaagaataatcatttagagagataaacttcaacggctttatatcattactttctaattctcttttaattccaaattcatctattaattcatactctattgccaaatcacagccctctctaatttctggagggggagcaacaaccttaattttatatttgtcttttaaaatgctctctgctctcattgcgtcttttgtgttttcaaatataattaatccttttccttctaaactctttttagctttttcttcttttttcccttttcctaatttaaaaagattctttaattttcctatcaagttatccctctaataaatctatttcatcatcctttggaatataatacctcaacctatctccagaccttaaaccatacagtaaagccctatccgtatagtttaaaattaaatgcatcaattcctcccctcttattcttaaatgcccatttgaacaacttatttcattaaattctttaacattatcaactctaacatttttgccgtaaaataagattggcacactttctccagaatggattaaattccctacagagggagttgaatggtctgcagttattatcagtaaatcatcctccctaagctttaaatttcctataagcttatcaatcttttcaatgactttaaccttatttaatggatttttagtgtgagctgcttcatctgtttcttttgtatgcagatggatgaaatcataatccaactctggaattaagtctatcccttcctcaaagctctcaatttttataaaatccatacctaagaatttagctaatcctttgaatagtgagctttctgctaaaataacagcattcattccccatttctctttaaagctctctaccctcttatatcttgatgcccattttgtcaataaaaagtttgctggcatcttctccaacttccttctctttctatttatcttatggttttgtagaattttatagacgtttaaaagatatttatttaacgcccttgcagtgtcttttgccttgctatactctacctcacttttacaaagctctcttattgctttaactttcataacatacctatttttataaaatgggtcagaatctgagattttatctgaaatccatccatttctttctttaatttttaatataaaatggacgtcaaaagaatagaaaagctcaaacttatatccatctacgcatgtagggagggaatcaaccaacttctcaatctcttctctgcttatatcttttgttcttctgtctataactaaaaatcccttctcatcctttttaacaaagcctaaagatgccctcagataaatggcatttttctctatctctatatcctcccctaaagcttcaataactcctctccctggaaattcttctaaggagtagccccaaagtagaaaatgagctacttctgtccctaaagggatgccttctttatacgtagtcattaagccacacatgccgttttcagctaatctatctaaatttggagtctttgcaaattgtagaggagttttgttattcaaaatttcggatgctctatctcccaaaccatccaatagaattaaaatagccctcattctctcactaaataagctttttaacgatatttaaatagttaaagtttcctttgtagccttcttttaaaatctcaactgaagcagggtagataaattcatttaacatctttaaaatcccttccttatcaaaaattacctttccatctttatctctatagtttccactaaatacacatgaaaattgcttctccccttgctcccattcttctcctatgatttctttgattttctttccctctcttatgtatcttataggtagaattaactcaacatcaaaatctctgcagattttgctatagacatttaaaacctcctctatttggtcaattttgaaatctccattgtgataaagtctctctccactaattatctttcctcctaagtgctttgccagaggaatcctaattattcttaaatatgcgtggcatccaatgcatggacggtaataaccatatcttttaaaagataaaaccacccatctcccatttaatgcattccagagttttggctcaaacataaaatgcaatggcagtaaaattttatccttatcaatttctttgattcttttattgacaatctcccagtttttgtaaaatatatttatgtttccatagtcagtcccagtaaatgcaacaaccggcagaacaaaatctatcccttcttcgatggctttgattattgccgctacgctatctctcccagaaaactctccaatagcaatttctctcagctttattccattctcttcaattattttaaacgtttcatcagataggggtagttctttaaaggattccttaaaatcaataaaatttggagtattttcattaaatatcatttatttcacctatacatctctaaataatcttttaacattctctcagttcttaaaacctctttaatatccatcaattcaatcaaaaacattttacatttaatgtctaagagcctatccaatatcggctttaaattgttgagatttttgggtggtaggtgctttccatcaacttcaatctcataaacgtgagagttataaactctatctgagcagatttctaagaactccaaccttctattataaggaatatgcccaacatcaaacgttatataacagttaatttcatcggctatctcaattatattattcggattcgatgaaaatcctttccttaaattctctatgcataattttattccatttttctctgcaaattcattaacaatcgataaattttcaattaatgtctctttgttaattttcccatattttccattgtgcaagtggattgttagataatccctacccttaatgttttcaattatgttttttaaaataataatgctctcttttttatccaaatccaaaattggagcatgataaccaataatgttgttgtcttttactatctttgggttgtaatgcaatccccaatccatcaacttgttgttaaaaagaaacccctccttggaacgcatgcatatagctatcatactcccacaaaacattaataggaaattaagatatataaaagtatatattagaaaatctaataactaaaagtaaaaagaaagaatttaaatcatctcaataaatgcctccaaccttgtttttaactgctctctatcactttcagaatagtcagtttcaattcttataattggaatgccctcctcttttaatgcctcctctaccttagctccctctatgttaaatgtatggcaatactgcaaagtgtaataaacaactccatcgacgtccaactctttaaccaatctctttatattttcaactctctcatcgtttttaaatctacaagcacatgggattttaaagtatctttttgcaatgtcctctacgctatagccctcaacaaagttttcaaagaatcttgttccagtgcagctttcttcaccaacaactactcctccaacttcctcaataatttcaacaatcttattgtttccagcaaccattggacagccagttattaaaattctctttccttcataaccttctccttttttaactctctcctctaactcctcaattaaatcctctaaaatccctattgtgtcatcaatatccaataaataggcaaactggaataattttaaaacatctaaacccttaattggagctggtttattcttcctcaattcatagagtttataaaacaactccctaactttatttactttatcaactgtctcttttaacttttcctctgttattttatttccagtctctttctcaaccaattcttttagcttttcaacttctttaatccagattttcaaagaatcttcatctttcatgtgtgggaggtgcattatatgcattggcaccaatctctccatcaactcaaacatcttcttctttccttcacaggtagtttctccaataactatatcagatgcttcaaagtaagggcaggtttttgccttcttaaaaccataggatgattttattaatgggcataggtttcttggcaaatcctcctctgctattgggattgtgtcatttttacctccacacaaaccaactgggattgcatttgctgctaaaattatttctattggaacataggcacagaacattccaaaaacttttctaccttcttctttttgcttatatagctgttcttttctactggcgaatttttgcatcaacttttcaattgcctttaatttcatcatatcaccaaatttaatatctatttagttattagattttctaataacttatgaagatttgggttatttttttaagaaattcattaaaagagtatatttctaatcataaaaatcttatcttcaaaatttttaatggtttagttgatattagaaaatctaataatagtagtaatacttatttaaaattctatcttatttaagtaataataatttaaattaagtagtaaattttatatatgatagttgaaaatagtattaatatattagtaatatcattgacataataaatattaaaaaaggtatcaaaaatctaagattagtaagataaaggaaagctagaaatcaaaattaaaacttagacaaaaataaacacagagaatttttatgacaaatagaacatttaggtgatattatgaaagttgttcatactatctgcccaggttgtagtgttggatgtggaattgatttgattgttaaagatgataaagttgttggcacttatccatacaagagacatccaataaatgaaggtaaaaactgttcaaatggaaaaaatagctataaaataatctatcatgaaaagagattaaaaaagccattgattaagaagaatggaaagcttgttgaagctacatgggatgaggctttaagctttattgcagagaaattaaagaattataatgctgatgatataaccttcatagcctctggaaaatgcacaaatgaagataactacgcattaaaaaagttggttgatagcttaaaagctaaaattgggcattgtatctgcaactctccaaaggtaaattatgctgaggtttctacaacaattgatgatattgagaacgcaaaaaacattataattattggtgatgtcttctctgaacatgcgttaattggtagaaaagttattaaggcaaaagaaaaaggatctaaggtaacaatttttaacacagaggagaaggaaatcctaaagctaaatgccgatgaatttgtgaaggttgatagttatttaggtgttgatttgagtaatgtcgataaaaataccattatcataattaatgccccagtaaatgttgatgagataattaaaactgcaaaggaaaataaagctaaggttttgccagttgcgaagcactgcaatacagttggagcaacacttataggcatccctgctttaaataaggatgaatattttgaattattaaaaaattcaaagttcttatacataatgggagagaatccagctttagttgataaagatgtcttaaaaaatgttgaatttttagttgtccaagatattataatgactgagacagcggagatggcagatgttgttttgccttcaacatgctgggctgaaaaggatgggacgtttataaacactgataagagaattcagaaaataaataaagctgtaaatcctcctggagatgctatggatgattggcttataataaaaagcttagctgaaaagcttggtagtgatttgggctttaactccttagaggatatacaacaggatattcacaggaataaacttctataaggaaattgacgcttttaggcatctaaataccttgaggatatataaactgtgaaagtcctgtttaaaagaaataactaaggtgatatcatgaaatacgttttaattcaagctacagacaatgggattttgaggagggctgagtgtggtggtgctgttacagccttatttaaatatctattagataaaaagcttgttgacggcgttttagctttaaagagaggagaagatgtttatgatggaattccaacatttataacgaattctaatgagttggttgagactgctggttctttacactgtgctcctacaaactttggaaagttgattgcaaaatacttagcagacaaaaagattgccgttcctgcaaagccatgtgatgcaatggctattagagaattggcaaaattaaatcaaataaacttagacaatgtttatatgattggtttgaattgtggaggaacgataagtccaataacagccatgaagatgattgaattattttatgaagttaatccattagatgttgttaaggaagagattgataagggtaagtttattatcgaattaaagaatggggagcataaggctgtaaaaatagaagaattggaggagaaaggctttggtaggaggaaaaattgccaaagatgcgaaataatgattccaaggatggcagatttagcctgcgggaattggggggctgaaaagggttggacatttgttgaaatctgttcagagagagggagaaaattagttgaagatgctgagaaagatggttatattaaaattaaacaaccttcagagaaggcaatacaagttagggagaaaattgaaagtataatgataaagttggctaaaaaattccaaaagaagcatttagaggaagagtatccaagcttagaaaaatggaaaaaatattggaatcgatgtataaaatgctacggttgtagggataactgccctttatgtttctgtgttgaatgtagtttagaaaaagattacattgaagaaaaaggtaaaatcccaccaaatccattaatattccaagggattagattgagccatatatcccaaagttgtataaactgtgggcagtgtgaagatgcatgcccaatggatattcctttagcttacatattccatagaatgcagctaaaaataagagacacattaggctatatcccgggagtagataacagtttgccaccactatttaatattgagaggtaaattaaaccaatatagctccaacacagcaaacaatctgtggttcttttggaattagtagttttttattcaattttttctcaaacatctcaaccaaaaccttatttttagcaactcctccactaaacactatgttttgaattttaagcctattggtcattgggataaccctatttattatactctcatagacgcccattaaaatgccttcctttggaactttttttgatagtaagcttattatctcactttcagcaaagacagcacacattgaagatattttagcgatattatctgatttgtatttatttatctcatttttatcaatttttaaaatatctaatgccttttctaagaattttccagttccagcggcacatttatctgataggataaaatcaacaacttttccgtttttatcaatctttaagacctttgtatcttgccctccaatgtctataactccatctgcctcgttaaagaaatagttagctccttttcccaatgcaataacttctggaactatcttatctgcaaaactaaccttatgccttccatatccagttgcaacgattttatctattggatatttttgttcaatctccttaaccatttttaataaaatatcttcctcaataacaactccaatatcctctatcttataccaaattatcttgctatcttccattagaaccatcttcgttgttgtagatccaacatctatccctaaaatcattttatcatcttctctaaagtttttacaaatttattgtaatctttttcattttttggatattctattgctttaatgatgatatttaatttttcaacctctttaaaaaattcttccatcaaaattcctctatttttaaaaatatcacaagttgtagagttttctatcccaattaagataaatttatagttgtcttttttatattcttgcagatatttgattattggttccaaaagttttttgcaaagttctctgtattcctttgtgtcatattcctcttttgtttttccttctctatcaattcccaaataaatcaactctggacatggaagttgtattattccataattattctttaaaagaatctcaacaacttcattaaaagctccttcagccctttccaacccattaacaacactattttgatttaatatgcgatgagaaacaatggctattctttttcctttcatactctcacaatttaatagaatgttaagagaaataaatttttaaggaaagttgatgacttttgatattcaataccttatgagaatatataaataaagtacaattattatttttaataatctaactctgataaaatcactggtttttctcaaaataggagtatataaagttattggtaaaaaatttaattactaactggatattaaaaaagctaatatcatccacacaaaattttacgaacatttagatttggacatcttgtattttctggtcttagttttaaataactttacaatatatcaaaaattttcatatcttatagagataaaaatttaaattaaaaagtttaagtcatgattgccttaaccgttgaagcaactattttatggaatattactgccccaacagctaatccaaatagataggctatagctgttttgtttccttcagcagccataatataattccttagaggacagcccccttgaacaactgaaaagaatccaactccaaaacctccaataattgcctaatgggtctcctgggattggtgaaaaccattatcaacaaaccatgggaacgctgaaatatttccagtagcactaaatataatatatccaatcaatgcgtcaacaaacaatccaaataaacctttaattaactaaacgctaaatattctccataatcagttctcaatgtttctctaattggacaaccacccattaatagagcatcaaaataccaattataaaaaattatataaaaaattacataagtcctattataaaatactaccaattagaatttctaataattttggagatattaaaaatccaatagcatggagatatttatggaagttccaatattcgtcgttatctctggcagtgatttgtatgggattccaaatccaagtgatgtagatatcagaggcgctcatatcttggatagagagctatttattaagaactgcctatataaaagcaaggaagaagaagttataaataaaatgtttggaaagtgtgattttgttagctttgagcttggaaagtttttaagagagttattaaagccaaatgctaactttattgagatagccttatctgataaggttttgtattcatcgaagtatcatgaagatgttaaagggatagcttataattgcatttgcaaaaagctatatcatcattggaagggatttgccaaacctctacaaaaattgtgtgagaaagaaagttataacaatccaaagacacttttatatattttgagagcttattatcaaggtattttatgcttagagagtggagaatttaaatcagattttagctcatttagatgcttagattgctacgatgaggatattgtgagctatctttttgaatgtaaagtaaataaaaagccagttgatgagagttataagaagaaaataaaaagctatttttatgagttgggtgtattgttagatgagagctataaaaactctaacctaattgatgagccatcagaaactgcaaagattaaggctatagagctttataaaaagctatactttgaggatgtgagagaatgataagcagtagatgcaaaaatataaaaccatcagcaattagggagatatttaacttagctacatctgattgcataaatttaggaataggagagccagattttgacactccaaagcatatcattgaggctgcaaaaagggctttagatgaggggaaaactcactactctccaaacaatggaattccagagcttagagaggagataagcaataagttaaaggatgattacaacttagacgttgataaggacaatattattgttacctgtggagcttcagaggcgttaatgttatctattatgactttgattgacagaggggatgaggttttaattccaaatccatcttttgtgtcttatttttcactaacagagtttgctgagggtaagattaagaatatagatttagatgaaaactttaatattgatttagagaaagttaaagaatcaataactaaaaaaacaaagctaataatatttaactctccatcaaatcctactggaaaagtctatgataaggagaccataaaaggcttggcagagattgctgaggattataatctaattattgtttcagatgaagtctatgataagattatctacgataagaagcattactctccaatgcaatttactgatagatgcatattaattaacggtttctctaaaacctatgccatgactggatggaggattggatatttggctgtttctgatgaactaaataaggagttagatttaatcaacaatatgattaagattcatcagtatagctttgcatgtgctacaacctttgctcaatatggggcattagcagctttaagaggtagtcaaaagtgtgttgaggatatggttagagagtttaaaatgaggagagatttaatctataatggattgaaggatatctttaaagtcaataagccagatggggcattctatatattcccagatgtttctgagtatggagatggggtagaggtagctaagaaattgattgagaataaggttttatgtgttcctggagttgcatttggtgagaatggagctaactatattaggttcagctatgctacnaaatatgaagatatagagaaagctttagggattataaaagagatttttgagtgaatttttagtattttattttaatgctcatttctcttctgattttaataaaagagtgtagaaaagagtaattgagtttaataaagaaaaacgttttatcccgaattggtctgattttaataaaataggaaataatattgtaactatcacagacatagatttccattccgaaacggtctgattttaatcattaaccactataaacttttttgtaacttaaaataagatttccattccgaaacggtctgattttaatcattaaccactataaacttttttgtaacttaaaataagatttccattccgaaacggtctgattttaatcattaaccactataaacttttttgtaacttaaaataagatttccattccgaaacggtctgattttaattggggggatgagatatgattttagaaggtttcgataaaaaatttccattccgaaacggtctgattttaattggctcggtaatgcttgggaacaattcaaatctggattatttccattccgaaacggtctgattttaatgaagaattagaaagctttttaaaagcaagagggtggtaataatttccattccgaaacggtctgattttaatttaaaagaagcgttaaagtattattatgctttaattatgtcatttccattccgaaacggtctgattttaatacagcttaatcccccttaacattaaccattgttttaacttatttccattccgaaacggtctgattttaatattagatttacctgtgagtgttgtagttccaagtagatatttccattccgaaacggtctgattttaatatgggaatgttaaataaaaaaaggttaaggagggagatataatttccattccgaaacggtctgattttaatttaaaagaagcgttaaagtattattatgctttaattatgtcatttccattccgaaacggtctgattttaattccactatctaagtcataagcaactacttcaccaatatttccattccgaaacggtctgattttaattctgaatttctgtctatcaattgttataatgctgtttgctttccattccgaaacggtctgattttaattgttccatcaacaaacgcagttattgagacaatttctactttccattccgaaacggtctgattttaatttatgatgaggaagctgaaagggatataattaaagttagtctttccattccgaaacggtctgattttaattatggggaaaaattttgaacttgaaggtatcgccacaagctgctttccattccgaaacggtctgattttaattcttcaaacatccaaataaagcatcaaattcttctatctttccattccgaaacggtctgattttaattttgatttccatcgtgaagtaatccaagtcgtagaaattactttccattccgaaacggtctgattttaattttgcattataaatttataaaaaagtattacattaatctttccattccgaaacggtctgattttaattctattaggtgctattctattagcctcatcaattatgctttccattccgaaacggtctgattttaatttcgaaagttgtaaaactgcagaatatgttaagagacagtttttccattccgaaacggtctgattttaattccgcagtattcagtatcttcactgtttgtattagatttttccattccgaaacggtctgattttaatttataatatccgcactgccagaatacaactctgcaaaatttccattccgaaacggtctgattttaattaatacgctacatacgctcctccatctaatgcaggagcaaatttccattccgaaacggtctgattttaattagggcaatcattcacaacataatatacttcatcactcttaatatttaagcttttctataccatatttttctaagggtaagtaactacttcataatataaaccctttagtatttaaatctttctttccataataaaacagagtatttttatctccttaaatttaaaaatttaacttatttgttagagaaattttatttacttacctaattaatcctaattttcaaaaattcaaataatttgattaagttaaatattctaaacaatcaaaccagcaaacccttagaaattaaatttaaaacctctaaataaacaaataagaaatttacatgaatcttttttaattataaagtttctcaatgtaataaacactaatgtagctctaattattaatgccctacggataataaaattagcaacgtaaattatttaagcattttgtatttacaatatttttaaacaaagttttaaatgagtgtgatggattatgataaatcaaataaagacctatttattaatggctttacttgtagggttaatttatgcaatttgtatgatgttgcatatacatccattgatagccataatcttagctttaattccaaatgttattgcatattatatgagtgataaacttgtattaatgagttacaacgcaaggattttagaagagcatgagatgccttggttacatcaaatggtcgaaagagttgcaagaaaagctggactaccaaaaccaaaagttgctatagttccaactgaaacaccaaatgcgtttgctacgggtagaaatccagaaaatgccgtagtggctgtaaccgaaggaatattaaaattactatccccagaagaattagaaggagtcattggacatgaaatatctcacataaaacatagagacatcttaataagcactatagtagccactttagctggagctatagtaatgattgcagagtggatgctatactggggaggaattttctttgtttctgaagaggaggagagtaatccattagagttaattggaacgattttgttattaatattagctccaattgctgctacaataatacagtttgcaatttcaagacagagagagttttacgcagatgaagagggagctaagctaacacatccattgtggctggctaatgcgttagctaagttagaaagaggggtagagttatacccattggagagaggaaatccagcaacagctcacatgtttataataaacccatttagaaaagattttattgccaaacttttctcaacacaccctccaactgaagagagaattgaaagactgttagagatgtgcaaaagaattggaaaataaaaaggtggcattgtggaaaaggaattaaaagtaataacaatagatgaactaaaaaaatacattagaaataatgaagaggacaagatagaggaggttgatgtagttacatcagcaacttgcggaataatgtctggaactgctggaatctttcatattccttttaatgaagtttttaagagggcggaggaaatatatttaaatgacattaaaggggttgttggcatctgcccaaatgaatttttaggaaaggttgatgcaatattttacggagaagtaggatttttatttaaagatttagttaagggcaaagttgtagaagctaaagccataagtgaaggcaaaatttacaaaaatgagataactatagatgatttaccaactgcaaagatgataggaacaagaatggcatttaaaaactatactgcaataactaatctatctgatgaggaagttaatacaatatttcacagattgcctctaaaaaaaggagaggcatcattctctggctgtggaatgcttaatccattagagaatatggttattaaagatgaaaaagatgttgttggaaaaaaagctctattaaatggtgctgaagctattatcttaggctttggaacaagggcatcgatagagaagccaaatctaatgatgtccgcagatatgaaagatatggatgcctattacttgggaggatttgtaacatcaaacggaatagagatttataatacaatagctgtcccaattaaagttgatgagcataaagaagctttaaaaaagcttgataaggatattaccctacctttagttaatatatttggtagagagattatagacattggaagttatgcagaggtctgggaaaacgtagatttaagaccaaaaatctatcaagataaatgtaaaaactgcagagagtgcttagttgaaaaatactgcccaacttttgccataaaaagagagaatggaaaaataaagataactgaagattgttttggttgtggagtttgcaatatttgcccttatggagtatttaaaacaaagcttggctctgtatgtggaattccaataacatgtaggcagtcagatagaaagagagctttaaaattagctaaagagttaaagaagaagatagagaggggagagtttaagatataaatttttcaaattcttcaataaattcttttggagttgggacttttaaatgtatgttattgatttttagatatttattttcgtctcttaatgatattaagtccttatctccagtaataatgatggctttcgattcataagcaacatttataaatttattgtcatcttcatctctacaaacattaaaattagtatttggatttataataaccgaaacagaagaaaaagcggtgagtatttttaaaattctattttcattccctaaatattttcttaattttggggataaacatttgaacccaatttcttttaaaattgaaggagatgtataattaacaatcttttcctcaaaaattaaatctaagattttcccaggaatgccattagggtttattaaagcagaaataaatacatttgtatcaataactactttaattttaattttttccattttttccattctttatctacctcatccaacaactcttcaatttctttttcatcaatttttatgtccttttttcttattttatactcctcccatatttttttgcattcttctctactcatttttttacttatggctatttcagttagtgattctctaacagcatatcttacaaactcatctctactgctaaaatacccttctttaataagctcatctatttgattaacgatactttttggaatcttaagagttatttcttcttcaatcatagcatcaccaaattatttacaactctcaacaatctcctttattgcattaacaacatactcaacctgttcccattctaatccatagacactcatcttaatctccttagtaactcctgctctaatccctccaattcccctcttcttcaactcatcatagaagaaaaaccctctcctcttatcctttttagctatctcatccaatactggtgtttcaaatttaattaaatcgtgttcttttggtttaattcctaactgcttaaatccaatcttttcaagttcatcaacaacatatcttgtttttttaagctcttcatcccattttttaaccctttcaacaacatgaggaaagcttgccattaaagtaactattggcagtcctctacttgtgcatccaagcatctcaatttctttaactgggaatttctctgatgtttttgttattttatcggaaaattcctcactaaatgccaaaataccacatggagctgatgctgccatactcttatgccctgatgcaacaataaaatcagccttaacttcctttccattgactggcattcttccaactgtatatgcacaatttagtaggaatgggatgcctttttctttagctattttaccaactttttttgcatcgtttaggttcccatactctccatctacatgagttaataatatcaatccgacattttttcccttgtcctctaaattatctataacctccttataaccctctaagtttatcttatatgttggatactcctcttcatagccaacctctgcaacgtttagcttagctctttcagcggcaacataacttgtgtagtgagcatttttatctaaaactacataatctccttctttacatatggcgtgcataacaataaattttccttcccttgccccgtgtgtaggtcttgcacagtccatatttaaaaacttggcaatatcttccaaaaagtcctttattggtgggcatgtaacctcatccaatcttccatggcagtaatcgcaaacgctataaccgtcccaatattcataaactgccttcttagcctcttttggtaaaatgcctcctctctgtattggatttaagttaataaattcccttgtcaagcttcttgttaagtttttgtatttatccaagtttatatccaaagtaatcacctcaaattttttagagtaaggcccctctaattccattaactatcatctgaactgctattgctgttaatatcaaacccatcattcttgttaatatcctaatccccaatcttccaatcctatctaaaacactctcagctgataatagggttaggtaggttattccaagagatagtagtatagccaatattaccaaaaacttatctccaatgtctgatgcctcagccattgcaaccatacaggcagttattgaaccaggcccagctaataatggagttgctaaaggcattagagcaatttcatcaatctcataagctgcttcaatttcctttctatgaattttagcctcctgctgacccctaaccatgtctaatgatattaagagcagtagaattcctccagcaatcttaaatgcatctaatgatataccaaaaaattttaatatccactctccaaaaagtgcaaaagccaataatatagcaagtgcataaataactgttttcttagctactaaatccctttccttttttggatatgactcagttaatgttataaatacaggaacagcaccaaatgggtttaaaattgagaatatagatgaaaatgccaatataaaatattgcaaatccatagtctcacattaaaattttatttttcttctaattcccccatataaatcaattacattcccatttaaaaatgcagtcatggtgtatatgactccgggaggaaggatattaacttcatctccatttttaacaaaatacaatttatcaaagctcagtaatcctccataaataagtccagctaattttggtatgtcatcaagctcctcaacagttataaccactacagggtcgtcactctcagctcctgtatatccaattcctgggatttctattggttcgttagagacagagcagccaacatcatagccaaacttttcccctatttccttaacaaacaaagccatttcatccacaaagctctctccaccataagtgtcaaaagctattattatagcgtctccatattcagatattgattcagctatggcataggataagccctctccagctttatctttatcttcagaaatgcctcttaaatcatcaaagccctcagcatatttatttaaaacttcgaaaattattttattatttttttcaatcaaattttctgggacaaaggatgttataactatatcatcaccagttatatttgagatagttgcttttatacctaatttagataatctttttttaatttccttattaactaattcattaactttaggatttgtttttacatcattgtctgatatatcaactccaatacttacaatgtattttttcattctatcatcctataaaaatggttgttgcaaaaggtttaaatttttgtagggtaaatattaatattaactacataaatataataaatataaaaatgccccgggaaaccgcgggggatgagcgacagcccggcaagctgtgagtcccctttgctcccccggggcacatttaaactaaacaataaaattatctattttgtaaattctaaaactgttttagcgattcctattttcataacttgcaatttaaagaactccccccaatactctttaaattttcttattgagtaattatcgtatatatattcgatatctacttttgcctcaaccaatatcaacccttctggtggaaatgtagggactccttctctatggttttcatctaaaagcttatcaatccattcaactggcttttttcctcttccaactaaatctaaagctccaactatctttctgaccatgttccataaaaagctctctccaatgatatctactgttaaatagaactcattttcagagatttttatatcatagattgttcttattggacttttttcttttgttctatctctctttgatagattgtggaaggaatgagtgccaatcatcttcttagctccttcttttattgcatctacatcataaccaatgtttgggagaatatatctgtaatgtctatacttcaccttaggaatttcatcaatctctctatatcctaaaacccagatgcctttatcctttagctttgcatttatgtatgagaggattggctcttttttcagctctacaactacaaagttgcctaaggcagagacgcctttatctgtccttcctccgctgtatataaccttctttttagctaaaaatccagtttcttctaaggcatctaacaaaatatcacaaactgtttgtttatgtggctgttgttgaaagctgtatcttccatcgtaggcgatttttagaatatacataaattaccaccttaaaattaattcatatttgtatattttcaaatttacaaaataaaaaactatttatatgacttttttattatttttaaggttccacaaatttttgaggtgaaatgttgaaagtcctcatctcccctttaggcgttggagatacaaatactgatgtttataaaaggcaatataaaacagcagagtataaatttgaaggagatatcgatggtattgaaagcccatttgttttgtcagttttaattgaaaagttgaaggttgataaagttattgttgttggaactgcaaaatcaatgtgggaaaaattatatgaatattatgccaaggaagttggagaatttgacgaagaatattggattgaaattgggaagaaagttggaatgtcaaaatatgataactatgctctttcagaagaagatttgaagaaaatagagaaggttattgataaatatttgaaaaaaattaatccaaatgctgttggaggttctaaatgcaagattataaagtatggaattgataaggatgagatttgggagaattttgatttatttatgagtttaataaatgaagtaaatgatggagatgagatttatttggacataactcattcatttaggtctattccattatttatgtatgttatgttggagtttatgaggtattttaaaaatgtaaagttaaagggaatctactatggaatgttagatgtaatccgtgaattgggacatgcaccagttgttgatttaagcccgatatttgaaatatcagagtggattagaggaatgtatgaattcaccacttatggaaacagttacttaatctcaaaacttttagaaaatgaagataaagagatagccgaaaaactacagaaaatctcaagatacattgatgctaattatttaaaagagttgagagaggaagttaaaactctaaaaccactgttaaatgagaaaaaagatacgggaaggtttttaaaatatttcattcctgagttgcataaatttattgataaattaaaatatgaagattcagattttgagttccaaatatctatggcaaaatggaactttgataataaaaaatacagctctggctatttatgtttaactgattcaatattttggaaattatgtgagctttataatttaccgtctgtttataaaaatagggaggttatgaagggaataatatacaatccatccttgaataaaaaatattctgcgtttgggtctattaaagatatgcattacaaaagattaaggaacataagaaacaaaattgcccatgcagatgttagtaaaaagggagatgatttcaatcctgaaaatgatttagaggatgttgtcaatttactgaaaaatgtcaatctacctgattttgataagataatcgaggatttactattagatgttaaaaataaccaaaataataaaacacttaaattgttaaaaaatattttgaatatacaaataattagaaagattattaaagcatataattttgagagcaatgaaatatactgggattttgttagtggttatctcttaaataagaataataaatgcaataatgaaaaattaagagaaatcatcgagatattccacaaaaacatagaggatgctggtgaattggaggaagcatttaattttgtaaaaaatacagaagatgaggaattgttggatagtttagcattacaaaatgcaatcatgcattatgccctcttcaaactttcaaatgcttataatatcaaaaataaggaagataaagaggcaattaaatgggttttgttaaatcaaaatctatgttcaaagcatccaattttgaaggagataaataacaactaccacaaaatattcaaaaataaggataaacctatgtctaatgagatacttgaagcatctaaaaatataataagactgttaaacagtgatttgtcagaaataaaagatagtgttcctctaaatttgataataatcagatatagaagttataaaaataatagaaggtgaaatcatgcctaaaatgtttttattattttctcataaacttacagatgaccaaattaatgatgcaaggaaaaatctgaaagttgatgaatttatttacttacctaaagaacttcaagagttgtggtctaacattccgcctgatgttgatgatattgataattacttaaaaccaataaaagagttcttagaaaaacatgctaaaccaaatgattatgttttaattcaaggggattttggtgctacatataaaatggtaaattttgcaattgataaaaacttaattcctatatattcaactacaaaacgaatcgcaaaagatatatataaggacggaaaaataattaccattagaaaatttaaacattgtagatttagaaaatataatccatattagtgttggtttagaaatgtaaagttgggggatttagatgggaaattgtaatgaatacactgccttaaaaattggggctttattgcacgatattggaaagtttattcaaagagccagtgataaaccaaaatctaaaggacatgataaatttggttatgaatttttaaaagagaagtttaagaatggatttttaaaccatttagatgaaaaaacaaaggataaaatattggaaattgttaaagaacaccataaccaaaaaattaaagatgatttaattggaattgttagattggctgactggctcagtagtggggaaagaagagaaccaaaaggagacccagaaaatgttgaggttttaaatactgaagaacaaaaattactttcaatatttgaaacagtgtgtattggagaattaactgaaaatctttataaaaatggatttaaatactctttaaaaccactaaatgtctctgatgctatatttacagacaaaccatatccaaatgaaaattataaagagttatttagtaaatttgaggatgaaattaaggatttcaaaggagatgtttcatttgaagaactctatcaactaatgcaaaaatatacgtggtgtattccttcagtaacgatgtggaaaaaagctggaagtttaaaaggtggtttgccagatgtttcactatttgaccactcaaaaacaacctgtgcaattgcctgctgtctctatcagatgtatgttaaagaaaacaagaagaaaaacaaatatgctaaagaatatattgatgataaaacattagaaaaactctttaacaacgataatggctggaataaagaaatattctcattaattcatggagatttgtctggaattcaagactttgtattcacaataacaacaaagtatgccacaaagtcattaaagggaagaagcttttatctggactttttaactgaatactttgcaaaatacatttgtaaagaattaaatcttccaattaccaatattttattctatggaggagggcatttctacattttaagctataaagttgatgaaaacttgataaataagttagaaaaagaaattaatgaagtactgttcaatatgtttagaactaaaatatatattacaattgcagaggttggtgtaaccccaaatgactttaaaaaatctgaagataaggagtcaaaagaaaaaacatggggatttgctaaaaaatggaaagaagtttctgaaaagacagttgaaaagaaacttagaaggtttgaatataaattggagggattatttgagccatacaatagggggagtgaaaataggtgtgtaatttgtaggaatgagtttgataaaaatgaaaaaggttatgcaatacgtgaaaatgaaagtaaatccgagagaatatgtgactattgtgcttcattcgtagctttaactgatatattaaaaaatttccaaatggaaaaaacaataaaatttaacaaagcatatccaattattcatttaactaaaaataaggacaatctctcacttcaaagagaagaatttagtttcttaacggttaaggcaatagaaaaattagaaagcaaatttagagttttatctgatgaaaattatttcttaaaagaatacaaactccctcacgactctggagaattaataattccatacaaaatctgggcaattgcattccctataattgaaaatgaaactgaaaaaagaatattagattttgatggattagctgaaaaagcttttgaaagaactggaacaagaaaaattggaatactaaaaatggacgttgataatttaggagaaatattcaccactggtttgggaaatgatgcaacaatctcaagaatgagcacattaagttctatgctaactttattcttcactggctatattcctcatttaattaaaaatgaagaatttgaagttaatgggaaaaaatacaagtttaaggataatatttacttagtatatgctggaggagatgatactttaattgttggagcatgggatgctgtttgggagttagctaagagaattagaggggactttaaaaaattcgtgtgctataatccttatataaccctaagtgctggaatagtgtttgttaatccaaagtttgagtttaaaaaggctgtaaatatggctgaagaagaattagagaatggtaaaaactatatcatatacgaagatgaggaaactgagaaaaaagtagataaaaacgctttaacggtctttaattgtccaatgaactgggatttagaagttgaatataatgaatactgctggactaaattaaagtcatatttagaaggaattaataaagaaatggtagaattagaaagtttagttaaaaaatttaatgaggatgatttggagaagaatttgaaaaagcaattgaagagacaaataagaaaagaatcctacatatagctcaaataactggagggaggttagagtatgtaattaagaaagatgatgagataattataaacctcccatactattggagagtaatttactacctacatagaaactacaaaggtaaagaaatggagtatgttaaattcttagaagattatgttagagagaaggttaaaaagatgttttcttcaaatgtcaaactcagctttaatgatttaaaagtttctgctaagattgttgagttgaaaaaaagaggggtgaaataatgtcaaaaattggaaaatgcatcttaaatcctaatgaaatcaatttaatactaaatattaacagccagaatgcaaatgagattatagacattgctgaaaatttagccaaagagtttgagcaaattcctgctacaaagatgagagacttttatgactacgttctaagaattgatgaaaaaaatgaaaactggtataaagaactggttttattaaaaccaaaattagcctataattacggaaaagagacaaatagaagaaagaaagaagcattggaaaaattagctgggacatttagtgagattatcgacaaaatagataatgatttgaataaatttaaaaacttcaagacattctttgaggcattggttgcttatcacaaaatctatgcaaaatcacaataaaataaaataagttggggggataagttatggaaaacttaacattaaaaggtaaagttatcttagagggaattattgaattagagacagggatgcacattgggggaacaaaagaaacattaaaaattggcggaactgacaacccagttattagggatgcttttggaagaatcctaattcctggtagttcattaaagggaaagattagggcattattggagaggaaagatggaaaatataaagaagacggtaggggaaattatctacctcacgattgtggagaatgtgaaatttgcaaaatatttggtcctcatgactcaaaaaatattaaagaaccagtaagggttatagttagagatgcatacttacaaccagaggaaaataagaaggattatgactatttggagattaaagttgagaatacaatagatagattaaaaggaactactataaaaggaggaattagaaacatggagagagttgtagctggaagtaaattcaaatttgaagttgtattcaacatttacaaagaaagtgataaagaattaatcaaaaaattcattgaaggaatgaagttgttagaggatgattatttaggaggttcaggaagtagaggttatggaaagataaaatttagggatataaaacttatctgcaagccaaaagaatattatgaaggaaatgaaaacagtaaaaaagagtctgatgaagttgaaagtttaaacgagttagaaagtgaattagataaaatttggggagggattaattttaactaacagttttaattaattttaatttttaactaaacttttttatggtgggcagagatgaaaatggttgtattgaaaccaaaaataaacagtaaatttcattttggggaaggaagtttggaaagaaacagtaaaatttttcattcaaatagtttgttttctgcaatagtgaataattacattaagctatatggaagggaagatttagagaaaaatatagaaaaaataaagaatattagattatcatccctattgtataaaataaagaacatctacctaattccaaaaccagaacatccagaattttataaattaaagggaaatcctggaattaaaccaaaagacattaaaaaaattcagtttttctcaataaaggcatataaggaattattagataatgagttggattggaagaataaaataaagcatattgttgattatcagacaataaataagagcattgttatttctgaaaaggaaattgaagaaataaaaagaatttttggtataaaagcagagaaacttaaacatgcaaaaattagcttaatatcaaaacatttagagcaaaaagttgctatagataggttaaaagacattacattagaaaaagatgacaaagggcaactctacaacatcgaatttataaaactaaatgaaaatgttgagttctatttcttaattgattacaacaatgaagataaagaatttatcaaaaaattagaggcatcaataaaattaatagaagatgaaggtttagggggaaaaagaagtattggagcaggattttttgagaaggttgagatagttgatttaccagaggattttaatgaaatattggatgaaaattcaaaatacaacaatctagaatataaaatgctcttgggagttggaattcctaataaagatgatataaaaaatattgaatattacaaattaattgaaattggtggctatatatactcattggaatgtttaacaaagccaaaaaggaatattttagctttaactgagggctcaattgtgaaaaatgactttataggggatgttaaagacatatcccctcaaaatgatgatgacgagcagaataagaataatgaaaacaacaataaacttaatcataaggtctatacccatggaaaaccaatattactcccatttaatccaaagagggataactatggaagttaaatgtgaattaataactccaattttcattggttgtggggaggaatacagtcaattagattattttatagaagatggattagctcatataattgatttggaaaaagcagtttctgatttggatgatttggaaaaggttgattatataagtggattaatagtttcaaatatagacaacaacaggttaaatctaacagctaaagatattttagaaagtgttggattaaatccttatgattatgttattaggaagatagaaagtgagatttttagcaataaaaaaacaagagttaaaaaatttattaaccaaaataacacctattatattccaggaagttcaataaaaggggctataagaacagcctatatattcaactattatgataaaaaccttcctgaattgctaaagatattagacgatagaaatataaaactacacgataaaggaaaagaattagaaaaaaatgcaatatcaaaagacattccaaaggatttctttaaatatcttaaaatctcagatagtttaaatttagaaggtgaatttaaattcatacatacaaaaagatggaattatagaaaaaagaaatttgatgttccaataaatatggaagggatgacaaaaggaacattttcaataaacataaaaattgaagatgaattttttaaaaatatcaataaaagactaaaaacaaattacaatccaaaagatgatgagaagaaatttgacatattaaaaaatctctgtaacaatttttcaaaaacagttgttgaatttgaattaaagaaaaacaatcctgtttatgttgaaaaatcctatgaaaaactcttagctgatataaacaaagatgatgcaatctatttgaacttaggatttggagggggctttttaaataaaacagtatatcctttattatggaaaaatgacgaaaatcatctttactttagaaaaataaagagtttgtttatcgctctaagtggtggaaataagaacttaaaaaatgcatggttaaaggcaaatagttatttagatttcccaacaacaaaaacagtttatgtcaaaaataactctgctattgctccattaggatggattaagatgacattggtggaataatgcaaaaaatattaattgctccatggggaaatttttcaagttggaaaaaagttatctactcatttaatggagttgaaaaagaatcaaaaagctctttatctgccatttatgataaaataaacccagataaagtttatatattggttttagatactttatctaatttagaatcagaaaattatggagatattgtaaaagaagttaaagaaaagacagagaattttataaaagaaaatttaaacattgataattacgaggtaattgtatgtcctggagttgggacattttataacaaagattttgaaaaatactttaaattttatgggaatttgactgattattattcttttgccctttatgaattgtctaaaagattggatggagatttggaagttcatttggacttaacacatggattaaattacatgcctgtcttaacctatagagtaattaaagacctcttagaaattttagcaataaaaaataaggttagattagttgtttataactcagacccctatgttggaagagaaaaagaaatattaaacatccacactgtggaagatgtgattataaaaccgtcctatgacattaaaggtatgactttggattttttagacgcaaccaaatttgtagataaaaaagaaataggaaaaataaaaaaagaaattaacatgaatccaaagataaaagaattaagaataatgaaacaaaatataaatgcatttatagcttctattgtttatgctctacctttagtttattcaacattctttgtaaagaaagataaaattgagatttatttaaatgaacttattggagcatttatttcaaatataaaaattaatccagaagataaaatattaaaaagatacttatatttcggagaaggatttaatagcttggttaaagcatattttgcttcaaagattagcgaaattcctcaattgataaaagacgagctatctttagaagagattgatgaattaaaaaataccttattcaaagaaaatccaaactctcaatatatcaaaaatgagatttcatccctttataacataataaacaccaaatataaagaagaagaacttagtgaaatcttaggaaattggactccaatatataaaattagaagggagaatattgacaaattcaagattaggaatttcttagcacatgctgggtttgaaaaaagtgtaactgaaatttatatttccgtagaaaataaaaatggaaaaattgaacttagtgaaaaaacttcgcttagatataataagaactacatagaagaaaaaaatggaatcaaaaggttcatatttaaatataaggacaaaaatggaaaagtagaggagataaatatcttagaaaaaattgaagagattctactaaacaaataaaatctctttttaataaaaagataaatatattccaatttaatactttttaataaacttaataataactaagtttatataataaactgtttcttaattatggattaaattaatttttatagggataaccatgttcagaccagaagagattatagaaacaatcaaaatgattaaaatggaaaacttagatttgagaacagtaacgttaggattaagtttgagagactgtgtttcaaaagatttagacgaattaaaggaaaacatatacaacaaaataacatcttcagctgaaaatttagtagaaacagctgaaagaatctctgaaaagtatgggattccaatagttaataagagaatagcagttacaccaatatcattagtcatcggtggagctataaaggatttagataaagaagagcaaataaaagcttgtgttgaggttggagaagtattagataaagctgctaagaaagttagagtagattttttaggaggatattcagcattggttcataaagacgcaacaaaggaggatagagctttaattgactctatcccatttatgatggaaaagacagagagagtttgctcctcagtaaatgttgcctcaacaaagacaggaattaatatggacgctgtaaagagaatgggagagattattaaagagacagcattcagaacagaaaaggctattggatgtgctaagcttgtagtttttgccaatgctcctgaagacaacccattcatggctggggcatttcatggagttggggaaggagataaggttataaacgtaggagtttcagggcctggagttgttagggcagttattgaaaaactgccagacgctgattttggaactttggcaaatgaaattaaaaaggtagcttttaaaattacaagagttggggaattgattggtagagaagtatctaaagagttgggagttaagtttggagttgttgatttgtcattagctccaactccagcaagaggagatagcattgccaacatcttagaagctatgggtttggaaaagtgtggaacccatggttcaacagcagcattggctttattaaacgatgccgttaaaaaaggaggggctatggctacaagctatgttggtggattgagtggggcatttattccagtcagtgaagatagtggaatggttgaggcagttgaggctggagccttaaccttagaaaaattagaggcaatgacttgtgtttgttctgtagggatagatatggttgccattccaggagataccccagcatcaacaatctctgcaataatagctgatgaaatggctattggagttataaacaacaaaacaactgctgtaaggattattccagttccgggcaaaaaggcaggagagtatgttgattatggtggtttgttaggaaaagctccaattatggaagttaataaatactcatctgagaagtttattaaaagaggaggtagaatcccagccccattgcaggcattaactaactaaatattaaaaatatcttttagctctttaaaaatcttattcttctctttctcaatcaatttatcaagtatgtaaatgttgtattctttaaagatatcttccttttttaaatttccatagaagccctttgttgaagctaaaacgccaaagttaatatttagtattttcataataccataaagctttaaaatggcatttgagcttatatgtctgtttttacattcaaaaataaagttttttccaaaaacatcaacaaataaatctatttctgtaaaaatatttcctttatagctaacatccaagtttctaataacctttgcatctatgttattttctttaaagaactctatgagagtgtaatacataaataactcaaatagagtcccagcatctaatgagcagaaatctttaaaatccttttttatttcatttataagctctaaaaagtaaatatcattttctttaattttttcagttatttctttaggtttatggctttctttaattttaggcagctgaaaattatgctccaacatggcttttctatatcttatctttgatagagtcagattaaaaagtttgtaaagattgtttccattatcagaagagaacccagtaagtttatattccccaaatttaatcctaacctctttctcattttttagctttaatttattcattatccatcaactcttctattgtatttatatttttgaaaattctcttactctcatccaattcttcagcttttatgtataaaggatttaaatatgagataaaatacctaatcgataagtttttatcctccataataattttatttagaatagataacgcatcccttttatataaagcaaagagtggctctatatatccattttcatgtttcggaattatacatagattgttgtttttttcagctatactaatattagatattaatttttttaaagcttctttatttatataagggcagtcacaaggcagaacaacaaaccacttggcatttaaaactctcatgccgcataagatacccattaacggccctttaccttcaattaaatcaaaggatattaagcatttatatttggttaaatattctttctccatctctaaatcaatagaattttttgcaaagactgtaacaaaagggatatttaaactttttaaaatatctgatggatagtttattagatatttcccattaaaaactctgaatggctttttcccaccaatcctctctcccttaccaccagataaaattatgccagcaatgatggttaccacctaaaacctaaaactttttgctaagtttataagttattaacatatttaataattattactgcaaatattatcatcacagttatgggtgataaccatgattacagttaaagtaaaaaatctaacaaaaaaatacggagattttaaagcgttagataaggtttcatttgaagctaagaaaggagaaatcttaggaattgttggaaaaagtggagctgggaaatcaacattaataagaattttaagaggaagtttagattatgatgagggagaggttgagattttaggtagaaaagacaactttaaagagattacagctatacacttgcaaagaaacttcgcactatgggcagagccagttataaacaacataattagaaagctttatgcaataagaaacaatgctgatgaacaacttccactggaagaagaatgggaggagtatgaaaaaacagctatagaaattttaaaattagttggtttagaacataaaaaagatgcctttgcaaatatactgagtggaggagaaaaacaaaggctaatcttaggaagacagatagctaaaatctatgaaaaaggagagggagtcttattattagatgaaccagcaacaatggcatgcccagcatcaaaacaaaagttattggatgtgattaaaaacatcagagacaagttaggaataacagttataataacctcccatttaccagaaatccacagatacctttgcgataggttaattctattagaaaatggaaaagtaaaaatggatggagatgttgaagaagttttaaatgaattcttaaagaagatgaaacccccatacaaaagaacacctaatataaaagataacgcaataatacaagttagaaatgtttctaaaagatattacgttgtgcatgggggagaaacattaaacttaagaaacgtctcattcgatgttaaagagggagaaattctatcaattattgggccaagtggtgttgggaaaactgtaattatgagattaatggctggtttagagttaccagatgaaggaaaaattatagttgatggtattgatataactaactatggatgggagagaatagagcttagaaagagaattggaattatgcatcaagagttctccctcccatattaccaaacagttgaaaatctattaaagtatagattaggacttaaaggagagaaagctattgcccatgcaaaggcaaaggctgaagaacttggattatctccaaagattgttgatgcactctaccaattaatagacgtcccagaatctgagagaatttcaaagcttcaaaagatgggattgacagaggatataatctataaactcttcccaccagtagttgagagctttgaaccagaagaaatcttagaggctttagatttaggaaaagatattttaaagaaaaaagttatcgaactaagtggagggcagaaagttagagtagctatggctttacagctgataacaaaaccaaaaatcttgttcttggatgagccgtttggagacttagacccaataactttaagagatgttgccaactacctaaagataatcaatgagagatttggaactacaatagttttagtttcacactgtgtagagtttattaaggagattagtgatagggctatactcttagatgagaacagattagttatggaagggaatccagaagaagtttgtgaagagtttataagaagaagtaacgcaaggtttatgaaggaagaattgaaatgcaaaaattaaaataattttaaacaatatctatcggctaaatttcaaagagggataatatgattattggtgtcttagcaattcagggagatgttgaagagcatgaggaagctattaaaaaagctggttatgaggcaaagaaagttaaaagagtagaggatttagaaggaattgatgccttaataattccaggaggggagagcacagctataggcaaattaatgaaaaagtatggattattagaaaaaataaaaaattctaatttgccaatattgggaacttgtgctggaatggttttgttatcaaaagggactggaattaatcaaattctactggaattgatggacattacagttaaaagaaacgcctatggaaggcaggtagatagctttgaaaaagaaattgaatttaaagatttaggaaaggtttatggagtatttataagagccccagtggttgataagattttaagtgatgatgttgaggttatagcaagagatggagataaaattgttggtgttaagcaaggaaaatatatggctctatcattccatccagagctatctgaagatggatataaggtttataagtattttgttgaaaactgtgttaaaaaataaaagattaaaagattatttctattttatctcaacctttgcatttaagaaaactggtcccctaacatctataaccttattctcccccattatctgttttaaagccaattcatcaatttttaggtttatgtcactcaaacttctaactattgggactctgaacttaaattcatccacatttgaaactaaagcctcttcaatcttagctactaatttatagataatcccatctatgtatctaatgtttgtagaaactccttcttccttagctttctttaaaattgggatatactgttctttaaccccttcaaacgttggcggaatgccatatatatttccatcatagacataaacctcatttaacacagaaggacctaaaagctttttatttggttcattctcaaatatttctactttaattactcttctctccccattgaaattgaattcccttttaacttcaactgaacatgggctttccttatctttatttgctatgcatatatcaataagctcatttgcaaagttgtagaattcatccaatataggaactttatcaactcttatcatcccagctatatctctatcactcaacctgtattcataaaattgaggataaaccattgccctaacatcctcatagccgtaaataatcattgccaacctctcaactcctaagccaaggttcataactggcacatctatgttatatttagctaatgcaattggtgaataaactccaaaggttgctacttcaatccactctcccaactttggatgataggcataaacctctgtttgagtttctggtgtataatacttactctttttctcatctggcttaaacttaaattttgtaaatccaaattgagccaacaatccttcagcaactacctttccatcatctacactaacatcttcaccaacaactacacaagatgcagagtgataactcattaaatggcttctatcctctctttgctcccttctaaaacatctatctatagagaataactttaaaggcagttttctcttctttattaaactgcttagagttataaaccacccagatgtcatgtggcttcttaaagttagagttgttgattctggcttcaaatctttaaattcaggaaatgcagtttctaaaaccttcaatcccatttcattactcacatttaaagctttggcaatctcaaagactaaatcatccccatctatagctccttttttgtataaatgtaaaacttctctcaacctctcttttttctcctcatctatatctatgcccaaattttttataatctcaaccttctcatttcctaaaccaacatctggccttggtaatccagccaagtaaaaacatctatctaaaactgccattgcttctggtccaaattgcttataaatctccatctcatcaacgataactggattaatcatctcttcaaatcccattcttagataagcttgtcttaatctctctatcgtctccatcactggatgtggctttccatagacaggctttaatcttggatatttattgtcaatatgtttatcctttattaatgcccttgtctctctccatgccgtctcaaaatccttctctgctaactctaaaaccttttttatatcaaatctcattttatcatcccttttatgttttaatttcatctaatatctctctaattgctaataaatctaatttactttgaggctttaagatgccttcctcaatattcacaaataggatgtttttcttaacagtccaaacaatctcttcacttatcttttcataaaatatctcatccctatttttaaagttttcaaatagcttaataactctctcaaatagctctttattatcatcctccaaggaatatagcaaatcctttaactgcctctttctaactctaagagattttttgcagaattctttaacatcctctcctaatagtttttcttgaattgcctcaaccaactttattggtttgcctccaaagtagtgccaaacaatatctatctcttcatcattaaagttatgcttctttaaaaaagcctttgttgttttatagtcaaagtcatcaactaagtagtatttacacctatcttttaatgttccttcgttataaaccctctctataaataaactatctgaacttaggcagaggacgtggcatagatgtttctccttagttaaatctataaagaagttaaacaactcataaattaaaaagccatttatttttaagtcccctattttttgtagttcatctataattagaattggttgtttgcctttcttcttaatatcttcaaaaattttagttaaatattcaaaaacattttcagaattttttgttgataaaaattcatttaaggtatttttagggactggaattccagttaatatcgttgatttaacatcaatattctttggtaaatcattaataaaacttaaaagatattttttaagcttttcaataaatgtctcctcataggtattaaacaaaacttcaataaaatcctcatacttagaaataaaatgctctctaaggtttatgtaaaaaacaacatacttatccctatcaagcttattctctataatatgctttattaatgtagttttaccactgtttatagggccataaataaaataaatcaaattaggctcaaaagatagaactttaactaaataattgatttctttctctctgtcaaagaattccatactatcaaccaacttaaaactttaagctaattaaatctggccttggcttcttaaatctatattcctctctgcaaatattacaaaactctctaactccaatattgatgatgtcatcacttccaggcagaactctaacaaatatccaatcagcatttatatcataacttttagccaactcctccaacttatttaaaatcttctctttaaatatctcaacgtcatcaacaaaaagccccctaacagttatcataattccaacacaaccacaccttgaggcaaagatatccatttctgaaataaaaatctctctacccaatagctttataaaaaacttttcaatctcttccctatccttcaaaatcttatctttcaatatttcacctttaaagccttctctgccaattccttacaaaagttgcatttgctacataatttattgcatgatttccaatactcaatagctccatctaatgccctattgtccaaataatagaaatgctccaactctcttgggcagtccaacaactccatcaaattaccatcccacctttcatttagataagcatttataactctctttatccagccaattggatggctccttccagatatcttaaatatatcaactaaacctttataatatttcaaatcctctggtcttatgaaggggctttttattattagctctttctttttaattcttaggtttatgcatttgttgtaatagtaatcatccaacgctgggatattctgggcgtttgcatgtgagaagaaattaaaatgctgtattctcatgggacatttgtatagacaagcttcattaactaaaatctttagcttacagctaacattctccctaatctcttggattatatcaaagtgtctatttattgaactatctaaggttatagcataaacttccttctcatcccaaaacagggctttatctaagctatccactaaggctatgcatgagacattaacctctaatccattatttttagctaaatctaccaaataagggtctgatagggcaacactatcaacaccaatgttttttagttggctgaatatccagtttatatagctaatgccttttggtgttaagtgcattccaccaatgcaagatgcgtttataacaacctcaaacctaacgttatgttttttggcataattaacttgtttagccaagtcttcaaaatttggtttatagagggttgctcttccagttcctacaaactctggaaagcctacatagacttcaaaactctcctttttaagctttttatttatctttctaagtttgttaatctcatttacaatgatttttaaagattcaaagtctccgggatgtgagatagagaacaattaaatcaccataaaattgttttaaagtaaattaataaacaaatagaatttaatacctattcttcatctttaacatagtttcttaaaatcccaataccttcaatctcacactccacaacatctccagcctttaactctccaacacctggaggagtaccagtggaaatgatatctccaggatagagtgtcattattgaagcgacaaactcaaccaattcataaacatcgaaaatcatattttttgtgtttgatttctgctttatttctccattaaccctacactcaatatttaagttcattgggtctatgtctttaactattctcggtcctattgggcagaatgtatcaaatgatttagctcttgtccattgtccatccttctgctgtaaatctctcgctgttacatcatttaaaattgtatatcccattatatagtcatttgcctcatcttttttgatatttttgcatttttttccaataactatggctaattcaacctcataatcaactctcttagatattcttggtcttattatgtaatcytcgttatagataattgctgaagttggctttaagaatattattggatactctggaatttccatattaagctcttttgcgtggtctatgtagtttaaacctacacagatgatttttgttggcttaatctcttttatattcaagctatcaccaatcttttgctttattgaatttaaatttaaatcaattattttatatttttctcctaatttctcaaatgaaataatcatctccctaaatgcatctaaaactcccctactgaattcatcaccctcatctaaataatcatcaacatagtcctctaaaattataaaacaatctcttaaataataagttaatgattcattatcaacctctgtttttgggaactttaaaatctcttttttaacagctccattaattcctcctcaaaatcaatattaagagatagttcttcaatatcaaaaccaaagcttatagcctcatctctaaaagtgtctaaaataatacacaaataaaagtccattgttatatagattaggatttttctcacagattgattttacttcaaaagctttctttatcagtttttcaaaaaatgattttaatagagattttaaggactttttcatattccccatccttaattataaaataacaacctttccatctacaacatcaattttaaccaaggtttttatcttatatccggttttttcttcaactatctttttcccttctcctctttcaataacgcaaataatgtcttttatctctgctccagccctttttaaagcatctattattgcaatcattgttcccccagttgagatgacatcatctataataacaactttatctcccttctctattccgtttagatagagttgccctttgctatatccagtagattgaaagacaggaatctctcctggtaatttatattctcttttcctcataatcacgtaaggtatatctgtgtataaagagagggtagttaccaaaggaatacccattgcttcagctgtaactaatttggtagctccttcaaagtctcctatctttattattcttgttgctacctctctcaataactttggctcaacaactggaactccgtcacttattggatgaataaagtaatgatactcccctcttttaacaattgggcatgattttaatgtttcttctaataacaatcttccacctccaaaggttataataccttataaacaccaggtcttggttcgaatatgtctcctgattctttcaactcagataaatatttttctaaatcctcttctgggatgttaattttttcagcaagttcttcataagtaatttcaccaacattttcaataatagccaaaatcttatcttttatgacatcagaatttaaaatttcagtatatacttcctcctctaaactcatctcctcattctcctcttcataaagttcagccctctctaataaatatttccttgtctttttaatttctaaatctctaagttttatccatctttcatctctctttctaataatctcagccatgatatatttctctccatcataagttcttggtctgccaatgacatcaactatgtctccctcttcaatatacactggcttttcttcaaagtatctgacattaactccatccacgtaaaaggatatgatgtttccaacgtttatattctcaacttttcctaaaattctaactctcctaacttttcttccctcaataattagggcgttatcaacaacctcattatttaaaaactcttctggatagattttataagcaacatatctcattttttcacctgttttatatataagtgggacattaattggggctgaaagccccaacttgatgggcgtcgggtatcccaataaggcggagccctatggtaagctacatatctcattttttcacctgaaacctttagttagtaatttaaatttcttctacacttaaaaataagcattttagatactcagtccctttagaagttattggatggtctgggctttgagaaccatactttataatcttagcccatttttttgcctttaagcaagcgtctataaccaaagctttaaaagcgtctggttctaagggttgagagcaagagcatgtaaccaacaacctatcagctaatttagctccaaatctatttagcatgtgatatccttttatagcagattttaaagctttctttgattgagcaaaagctggagggtctaatataacaacatcaaacttctccccatcctctataaactcctccataactttaaaggcattcccctcaataaattcatatctatcttttggaatattgtttaactccatgttttcttctgccaattttaatgccttttttgataaatccactcctacaacctcagctcctcttatcgctgcatgaactgaaaatccaccagtgtaacaacatatatccaaaaccctatctccctcttttataaacttctcaagctctaacctattttctctctggtctaagaaaaagccagttttctgcccatcaaatgtaactttaaattttgcctctccctcttgaatgatagtttctgttttctctccagccaatattccttctacttctggtaatccagctctctttctattccttccagaacttttttcatatatgctgtcaatgcctaaatctaaaagagtttcaacaacaacatccttcatcttctcaataccatagttaaatatctgaactgtagctatgtcattgtatttatcaataactaagccatttaaccaatctgactgagtataaaccattctataagtatctttaaatcctaattttagtctatattcatttgctttaattatcttctctcttatgtagttttcatccaaatcttcttttctcaaagtcattattcttacttcttttggatttttaaaacctctccctaaaaattttcctctctttgagtagatatcaacaacttctccaatctcaatactgtcaaagtcctctttatttaaaatattatcccttggaatgattaaatttcctttttctatagcagaatatcctccaaaatcaacatatagctttgtagtcatagctaattcaccattttatttttcttctttttcatttagttttagtttttcagtatatctacactttggatagttagagcaaccaacaaactttccaaacttaccttctctaacaactaaatctcctccacatttagggcattttcctacaacttcttttttatttattggttctgtatatttacactttggatagtttgaacaaccataaaatgctccataaactcctttctttaaaattagcttagctccgcactttgggcaaatcctatcttcttctttaacctctacttgttttaaaggacattctggatttatgcatatctctctatctcctatttttaaaataggtgatttacatgcatcacaaactttgtttggaatttttatcctacctttatctggtaaggagtattttacatcacattcaggatagttagagcagccaacaaacctgccctttttatgtcttattaaaattaagtctcctccacatttaggacattttccaacaatttttgcttttttatttgtggcatctaagtttttgataaggtagattccaatatcttcctctttctttttaaattcttccaatatttttcttaatcttttttcagcctcatctaaaacatcatcctttttaatttttctaaactgtattttctccaacttttcctctaaatcccttgtcatcttttcatcgataatttctgggcagaatctttttaatgtctcgattactgaaattcctaagtcagttacttttaaagaaccatcatcaatgacatagcccctttttattaatttgtctatgatctctgccctagtggcttttgttcccagccctcttttctctaattccttaattatgcttgcaacagtgtatctttttggtggttgcgtttcttttcttgttattgttatcttttcaactttaattatgtcatttttctttaatgggggcaattcaatctcatcaaattttgggaagtaataaatttcatgccatccttcttttactgtccttgaaccagataacttaaacttctctcctttaatgtcaatttttacatttaaatattccctctctgcattatcccaaaaagcagctaaagttcttcttgcaattaaatcataaatctccttctctttttctgaaagttcttcctttggaatatctacaatgtgtatagctggatgtgcagggtcttctttctttccttcaactggttttaaattctcttttaaaattctctctgcccattttccataaactggatgattttttattatatttagaatatcttccaaatactttctatcttttggaagtttttggctggatgttctcggatagctaattagagcattctcataaagcttttgggcaatttcttgcgtttcctttggagatattttaaaataactatatgcctctctctgtagagttcctaagtcaaaaggtggaagtggctttaactttctttttgttttctttatttcaacaactttggcagatttttcatcttttattttttcataaacattttttgcctctttttcattccaaaatttctctttctcgtgtattgcctttaaattatcttttaatagtgcctcaataacccaatacggctttgggataaattttttaatttccaattctctttcagttaaaaaagctaatgcaggaccttgaactcttccaacactcatcgttttccatctattcactgcccttatggcgttcatcaaagctctcgataggtttataccaaaataccaatctaaaatatgcctgctctctcctgcatcaactaagccgtaatcaatctcatccggattttcaaatgctctaactatctctttttttgttaatgatgagaatctcattctctttgccttttctcttccacaacaatattttaatgcgtgataacctattagctccccttcaatgtcccaatctgttgctatatagaactcatctgcatcttttgatagtttttttaatgcctttatgtatttatttacatactcttttcccttatcaacacttgcaggcacccattttatatcaaatactggataaaagccaaattctttattctctttttcaactaaggtaaatagatgcccaacagcacttgctactataatttttttcccatctctttctaattcatagtatggaactccatcaatgctttttttcttagcttttcctaaagcgtttgctatctttttggcaacacttggtttttcacagattattaacgctgtcataatttcagccacgcgtatctaactgaatatattataatttatatatgatttctttgtaattagttgtagttgtggtaaataaatatttttggggatttatatgagggatgatattttagatatcataaccttaacaactgactttggaactaatgagggatatgttggagctatgaaaggtagaattctaaatattttaaaaaagtataataaagatgcaaaaataattgacatctctcatgaaataaaaccatttaatatatatcacggtgcttatgttttattaacagctattccatactttcctccttcagttcatgttgcagttatagacccaacggttgggagtgagagaaaatccatcgttattgaaacaaaaagtgggtattatttagttgggcctgataatggattatttacctacgtagctgaaaaattggggataaaaaggattattaaaattgatgaagaaagatacaaaccatcttcaacatttcatggaagagatgtttatgctgttgtaggagctgagattttaatcaataatggctatgatggggaagaattggatgagatggttaagatagatgaaacaaaaaagagagttatacacattgacagatttggaaatataataacgaacataaaaaaggatgaagttacatttaaatattatgataccataatgataaagataaggcataagaatggcattgaaaagattataaaatgtaagtttgttaagtcctattttgaggaaaagaacaactttatatgcttaataaatagtgaaggatttttagaaatctccaagtttatggacaatgcctcaaagttattgaatgttgattatttagatgagattgagattatttattaaatgtatttcatgaaagaattttattttatttttatacctacatgataatggtaaatttacggataataaattttattggtgatattatgaagattaggggaatttgctacagatgtggagctgaagatgaacttatagatggactctgcccaatttgctatgctcaggagcatccattaattgaagttccagatagagttgagatagaagtttgtcatatgtgtggttcttacaaaagaaaaatttggcaaacaccaaaaagtgaagaagcatttgagatattgaatgaaattgcttattatgcaacaaaagacgctattaaaaagaaaagtgttatggttgaagtagagatttatcctgaagttacccaacttcctggagggaagagaagtaagttaattattccagtgcatattgtagccaggggaagattaccgggagagaaagaagacagaacctatgagaaagatatagaagtgcatttaaggatggttcagtgtccaagatgttcaagatttatgtctaactattatgaggcaaccttacaagttagggctatgaatagatatttaactgaagaggagagagaggagttggataactttgttagagaagagttggctaaaagattaaagaaggatagaatggcatttatagcaaaattcattccacaaaaagagggattggattatcagcttggttcagttggagctgcaaggaatgtagctcaaagaattaaagagaaatatggtggaaagattactgaaactgctacattagttggagtggatagagatagtggaaaagaactttatagagttactgtttctgtaagggttcctgaatataaagttggggatgtcgttgagtataaagataaatactacttagttactgcgataactgaagataaggtttatatgaaatctattgattataaaagagaaaaaatcggattagcttggcatatagcagagaaggaaacaaaaatggcaaaaaagaaggatgaattagacactgcaacggttatagctacaactccaaccattatggttatggatgacaaaagttatgaggtttatgaatttgataacattggagatgtgaagattaaagagggtgataaagttaagatatttaaaaaagaaggggtttcttatttggtaaataaaatagagggaaaagataaacaataactttggtgatgatattgattaaattagagatagacagaagggcttacaattcaataaaaaatttttcaaggttagtttatacaaaagccataaaaaatagaggggatttaccaaaaaaagaggaaatcgttactttaacttataatggaaaatttgttgctaaggctttatataaccctaaatcagtaattttaaaaattttaactactgaagatgaagaaattgattatgatttcttctacaaaagaatatttaacgctaaaatttatagagaaaatattttaaattataaaaacacttacagatggatttatgctgaaggagatgagttaccaacaataatatttgataaatacaacgagctcggagctatgcagttgatgtcaaagctcattgaaaaggagtatttaaaagatattgttgatattttatttgaattatctgacttagaaacaatatatgtcaaaagaggaaagaaaggggaaagaattagggacaaaatctttggagataaaaataaatttgaaacagttattaaagaaggagatgctaaatttaaagtgaatgttagagggcataaaacaggctttttcttagaccagagggagaatagattatatcttgagaagtttataaaagagggagatagagttttagatatctgctgttatactggaggtttctctgttcatgcagcgataagaggagctgaagttgtaggagtagatttgtccaaaaaggcattaaaattggcagaagaaaacatagagttgaacaatattccaaaggacagatatgagtttattgaagggaatgcctttgaagttatgaaagagatgattgaggataaagagaagtttgatgttgttatattagaccctccagcttttacacagacagaggatgacataaaaaatgccctaagggcttatgcatctttaaattatttggggataaagttagctaaaagaatatttgtcacttgctcttgctctcaccatgtagataaagaaatgtttaaaagaacagttatatcttctgcctttagagcaaaaaaagagttaattatgattgattataaaggacaagctccagaccatccaatatctataggaaataaaaatcttgagtatttaaaatgtattttcttttatgttaagaattaaatcctcttagcataatctatcatgcccttaaacattttcaacccatcatctgaaccaagaatcttttcacttgctctctctgggtgtggcattaataaaacgcagttttgattttcattgcaaactccagctatattatcaatagaaccatttggatttgcttcttcagttacttcaccagtttcatcacagtatttaaagacaatcatgttatttttatacatataatctaaagtctcatcatctgcatagaatcttccctcagcatgggcgataggaatttttaaaacctctccttttttataatattgagtgaatggtgttttgttattttcaaccctaatataaacccatttacagataaattttgcatttaagttgtttgtcaaagttccttttgaaaatcccgcctctaaaccaatttgagcaccattacatattcctaaaactggctttccttcttcaaccatcttttttagacctttaattataggagttcttgcactaattgctcctgctcttaaataatccccataggaaaatcctcctggaataactgctcctttatagctatctaaattttcttgagtaaagaaaacaagttctggctctccaccagctaatttaactgcatgacatacatctaaatcacaattagtccctaagaattttgtcactgctatcttcatgctctccccttgttactaatcctgatgttattaatctatagttcttttcaaaatattttgtaataactaaggcactgatgaactccttcctaatggaaggagttcaaacttccttaataaattttattcacttttgaaaagaactataattcagatgttattacattcaacatctctttaattaatattggcatcttatcagttctttcactaagttccataatctttctctttaatctttcatcatcacactgtttaatatctcttgctttaattgtttttctcccttcctttcttgcattttgctctgcaacttcagttgttatctttataatttcttcaagcatattacagagttcatcaaccgcctctgcagagatgttaaagtctgtgtgttgtttcataatcctctttactgtagcttttggtaacataaatatatacctccaaaaatttttgaaataaaaataataaaaataaagataataaaatgtttattttatttttgctctacatttacagcccctattctaatcaatggaattaaaggaacgccttcaatctcatccaatccacttttatctatcaatacaactactaattttgggctgcatacttctttcaactgctttatacactcctttaaagtgcttccacttgttacaacatcatctatgataacagctctcttgtaatttacagctgagaagttttgtgatattgaaccagttatctttttcccttcttcagatatatgcttctttggtatgtagatagttaattctttacctaattcggaagctaccaaagtagctataggaactccacttgtagagactccaacaacggtatcgaattcgatattcctgctctttaaaatatcaactattattgagctaatgtattttaacctatttgctgagctaccaatatttttccaatcaatgaatatatcaacattttcaagctttatagctttttcctcctcttttaacaatttctcagcatttaaaaccaaatatcttgctgtctccattgatacatttagttcctcagcaatctctccaattgtaagtccattactttttaactctataaccttttttaataattctttattcataatctccctcattcaataatgattttacagtatatgttataacatccccaaatacttatgcatttgtattgttagcataacattatctttcaaatactctccacatgcttccataatttcaaacaatttcctttgagaaggagattttatatttccatggggggttactggttgaatgcataaagttatatttcctatatcactcaaatcctttgctattatttttacatcctctatatttgtctcttccattataacaacctttgcataaatatcagaatttaaattatacagcttttttattgttttaagctcatttttatagagtttttcataatcttcatcttttatatactcaaaatgctctttcaactttatatcaatggatgcgatatcaaaataaaaaattctctctggaaacatcccattgctctctaagaaagttctgtatcctttatcttttaaaatttcagcgatttcttttatttgtttatggtagagtaatggctctcctcctgtaaaagatactgcaaacaaatctggtgtttttagcttatctatagcgtttattatgtcttcaatctccatcttttgcagagtttcaaattctccacttccagggattttttccactctattaaaatatcctttgctctcttcatcgcaataaacacagtttaatggacatccagcaaatctcacaaatataaaccttctccctatatattttccttctcccattattgagttaaaaatttcccttatcatcttaccccattttatttaattctcactttttaaatcatcaggtaaagagaaatatgcaacaatctctaaaatttgggcaacaattattacaataatcccaacaatcactattaaaagtagtgttccaataaaatacagcaatccacaaattctaaatgaatcaacaccagtgtaatatgaaaccttttcataacttttctttataaagtaacctccaataactgaaaggatataaaacaaaataacaccaactaaaaaagatgacattgccgttagtccataatctagtgggataaatgaaagagatacaaaagaaattcctactgcaaaaattacaattaatacagctattatccataaaacaacaccatataaatattttttaaacacctcatcatcattaaaaatctttgaaatcttatttaatgccagcagtattaaaacatatccagcaatagctaaaattcccccaactgcataagaaactaaatttaataccgccccaatacctcctaaatatttagcttcttttaattccattttaatcacctaaaaataaactaaaaataagcctcttagaatctataatctaatccctacaactttacttaatccattttcacaccatagggctctgccctattggaatatccgggatgcactgcctcgctaacgcttggcagtgcctcttaaaccttataatctaataccaacaactttacttaaaccgttttccatataaacaccataaacaacatctgccttactaaccatctgttctctatggcttataactataaattggctgtctttagaggcgtttttaatcatatcagcaattaaagagacgttttttacatctaaagcggcatcaacttcatccaatacatagaatggcgaaggatttagcctttgaatagcaaataaaaatgctaaagctgttaatgattttyctcccccactcatagcatctaagcttaaaagctttttgcctcttggagatgcatctatcaaaatccctccttcaaatggattcttctcattctctaagctcagcttcccaatacctccaatctccttatatacttcctcaaagttcttagctaccttgttaaaaacctccataaagacttctttctttttattttcaagctcttccatcaattggagatattttttctcatctctctcatactcttttcttttttctatcaactccttgtatctctctgccacatagttatagtcttcaatagccctcatattaactggttctaagctttttatctcattctcaagctctcctatatatatctcaagttcttcaatgtcttttttctccaactctttacttacatcaactttttcgcatagataaagctttctctcctcttcctccaacttactttcatacttcgccttttcaaccatgagttcgtttattctgttttcaatgtctctaactttccttaatatctctcttctctctctttctaaggtttctatctctttctcaagctgttcctttttttcggtcagctcttttaggtttttagctaattcctcatatctcttcctcttctcctccaatatagatagatttttttcaatactctctttatagaacgatatattcttctccaatatgacttttttatttattagctcagagactttcttattcagttcctcaatctttggaattaatatctctttaactaaagtaagccctttatcaatctcattttttaatttggctttctctttctctaaaatctttaattccccttcaatttcgttcattctctttaagttttcatcactttcatactccttcagctcattaattatcttctcccttctttcaatcaactcatttattttactctcaatttcattaatcctatttaaaatctcctccctcttaagattcaactcctccaactcctctaaaatatctttatttttcaactccaactcttttatctttatagtgttcttttcagcaatctctctcttcctcatttcattctttttaattatctctaatgtattttcaatctccatttttttggcagaacttctctttactatcttacttaatctctcaatttcttcttttatcttcctcaactcactctcaatggctataatttcatcagctatcttattcagcttacttaaatcaacatcaacctttatctttgccttacttttaaaagtccctccaatcatcgccccactcggctctataacatctccatctaatgttacaaacctcacctttctgtattttttagccaactccttagctatatcaatattttcaacaactacagtgtttccaaacacatactcaaaaactctcctatatttttcatcaaactccactaaatcaatagctctaccaataactccatcttcatcaatataatacgcctctctgccctcaattctatccaatggcaaaaacgtggctcttccaagctttctctcttttaaatactttatagctctaactgcatcatccattctcttaacaactatatgattcagcctatttccagctgctacttctatagctgttttatactcaatttttgtctttcctaaattaccaacaatgtcgataattcccggtaagttggcattcaatatctctctaattgccctatccatagatagctcttccatctcctttaaagccttgattcttgcattctctttaacatactcagcatgtaactcatccaatttagcttgtagttctttctttttttcctcaagttctttaatccccctctttgaaaactcaatctcaacgtttaaattttcaagctctaaatacaatggcttagtatcaacgtcttcaacagtttcaagttcctcctttaactttttaatcatctcattgtttttttcaatttcaaaattctttctgtttatcaaattatctaaatcatttaattctttttttagcctatagagttcgttctggtttttagctatttcatcagctatctccatctcagattcttttaagtgtttgatgatgctctcgctttcagcaatagcctcttttaatctctctttttcatagttgagattcttgattttctcttcaatttcttttatctgctgttctttctcaataatgctgtctctattttcaataatcttcttttgagtttctttaatctccttcttcttattttcaatttcaacttcaaccttttttagctcatttattgagctatctaaaaccttcttatcgttctcaatctctacttcaagctctttaattgatttatgaagctctaaaacttcttcattgcccttctcgttgagttcatttatgatgttgtttaatctaagctttaaattctcaatctctacatcaatttctctaaccttgcttaaaaattcatttttaagctcttccaaatttttaatgtcattttggatgttctctaaaagaacatttaggtagctaactttttttaatatcaaagcatacttagcagcttttagctcttcatttaattttatatatttttctgcatcttctttctcttttttaagcttctttaaattgttttcaacctcactaatccttatatcaatcatctcaattaactctctggctttttttaactcctcctctgccttcttctttttttcatcaaactctgctattccactaatctcatcgataatctttcttctctcaattggtgagatattgataattttcaacaaatctccttgtgaaataacattatctcctaaaagccccaatcttctaaataaatcaataatttcatgcttagtcatcttctttctcttctccttatcgttctctttccaaactaaataatagtctgtctctccactactctttatccttcttaaaattcctactttatcagcattaacattgaaggcattattctcatttgtaaaatataaacaaacttcagcaaaatctgccctctttccgttgtggtaggttatcaaaccgctgaatctatttgctctcaattttttagcagaggtttttccaagcacaaataatatagcatcgactatgttagattttccactaccattaggcccaactatggctgtaaatccctttggaatatctaaagataattttttaaatgatttaaagttttttagttctattttttccaaagtaaccattacaatcaccagatgatgcaaaacaattttcactttttttattatcaactaatctaacttcaaattggcagaatttatttcccaatccccagcaatgagtttctattatgtaacactttttattaaatacattttctatgtaacctgccaaaaaccctgcctcaaaatgacataagggctttccaacatctggcaatccagaacagcttatacaatcatatattctaatctttataggattttcactaaccatttcaattcttccaagtttatactctttatagaagttacttaattctttaaaattcttaaaattcagatttttactaagttctttaccaaaataatacattaacatttcattgtcaataccaatatatttcctcaaattcataaatcttaaaattctaaaaatagacacatctacatttctcccaagttcttccattctccactacgggagtatttaggaattttaactgatcttctctccacctaaagggtggaggttccaacacggaacaccctgctacttatcgtcgccgataggtcacagggcaggttggtgtcatcgggcagagtcagagctaccctcaataaagcattatactaatttcaagtatataaaactaatgtttgtctcgccgcctccctatcttcgagcgtagcaaggagagttaatgaaattcgaaggatttcatctgaatcctctccgagctaaagcttggagcttccttagcaacaactaatggtgagtttataaaatatatacttaaactatttatatgaagcttaagtataataattcataaaatatgaatttatgggataatatgttgagaggtaaagaagctaccttagctgggataataagggtcatcattgaagaagagccagagacacaagatgaaattgctgaaaagcttggaataagtaggaggtatgttgctaagcttttaaagccattgattgatgaaaaaatcgttaggcatccatatattgtagatatgagtaaattgcataagataaatttagagtttgacgaatatatcttaatgaaagaaataaaaactaccttagaaaaaatggaaaaaacacttttaaataacttggatttggtttatacggctttaaaaaatagtgataagaaattggctgaggatataatcattaaagactatgcactgaataagatggaggaagaggttaggatactcttaagtatgaatgctttaaaatatttgcctggagcttatgccaatgctttggctacaatagcatcaaatcttgagaggttgggggattatatagcaaacattgctgaagaagtagttcatggacttaaattagataaagacattgaaaatgaagttaatatgatattcacccttctcaaagagatgctaactgaagctatagacgttgttaaaagtaagaaaaaggagacaaaaattcatgagcttgaggaaaagttgcataaaaaccttgagttattgctaaacaaagttttagaaaataagagggaggatttaaacttctatgttcagtttggtatgtttttaaaggacattgagagatttggagatagatgtgtgaatattgtagatattgcgttagagttatatcacaacataccaagaaatccaattcctgagaggttgaaaaggggaatgttataagggaatttttaatttacacctctgagcataagcgaagaggtgttagctttgatgaaatggaaagctttgctttccagctacaaatccgttaggatttgttaaactttattaaagtttcggagggatgttatgagagaatttatattcaaagcaaataaaaccataacctcctcagatataaatttaaaggatttacctgggagttgtggaaggttggatttgttatgcagatgtgtgagtgacgctttctttttatcccatgatataaggagggacgttgttttctatgctgttctttatggacagccaaatcctcctgtttgcataaaatttgttggtagtgagttaaaaaaggtttctccagatgaaaggaatatagcaatatttataaaaaaagcccttaaaaaatttgaagaacttgatgaagagcaaagaaaggattggaatcaatcaactcctggaatttacgttagaagattgggatttaggaatttagttttggaaaagttggaagaaggaaagaatatttattatttacatatgaatggagaagatgttgagaacgttgatatagaaaatccagtttttataattggagaccatattggtattggagaggaggatgaaaggtttttagatgagattaaagctaaaagaatctccctatctccattagaattgcatgcaaatcattgtattactataatacacaatgttttagataagaaaagaatatgtgagatttaatatgttgttaattgttaaatatctaatttcaaagttatttcctcaatattatttaaatctatagttgttttaccatttataaccagagttccactgtttatgactaacttgttatcatcataatcttcaatatttggtgtatttagattatgagttatgatagaatcatcttttagtttaagtcttatttcaataatattaatgttatctccattttccttctttcttcgtaattcattaattaagcctcctaattttgtaatttcagaatttctttcatctatttttttgtcatccaacacattatctactactatatctccactggaattttcaagatttactttaatattatatggagaattcttgtctaatggttcaaagaaaggtctgtattttgctggtatatatagagacaaatccccacccaagcgtaaaacaaaatacataatactgtctcccttaataacaaaatacacaatcccacctctttaatatagtcattagtattatatattgacatattagtataatcaaaaaagaagaaatatattaaacttacgtaattacatataacaatttttgagggttaagttatgaattttgaaaaaattatagaggaaaaagtaaatcaaaaactcaaagaattgaggctaaaaaactccttagaaattttagagaaattagatattaatacagagcttaaagaagctttaaaatccacgcttttaaagagattaaatggagagaaagagttttataaaatttccattgataaaaagccaaaggcagttgttgcatttagtggaggagttgatagctctacatctgcaataatagcaaagcagatttttgatgttaaggcagtttcttgctattcaaaatatataatgacagatgagatgagagaaaatgccaaaaacatagctaagaagattggaataagtttagaatttgtgagtattgatttagaggaagtttataaaggagttgttaatggtaaatttcatccctgcggtagatgccataaagttatcgaaaatgcagttatagattatgccaaaaaaatagatgctgagtttgttatatttggtgatttattagcttttggatatttagctttatatagggaggatgagatttttagatttaatctaccttctttttttgccctaacaaaggatgaagagagggagatattaaaaaacaatggcattgagctaaaaatgagttatggctgcccattgttaaaaatttaccataaacataataagggatataaatttacaattcaaaggattttgagggaagttaggggaagggtagttaatgaagaagaaggattcaaaaatatagttgagattttaaatcagcaataaaaaacccttccagggaatatataagatgttaccttcaacttttaactcatcaccgataattatgcccttagaagctttaaccctctccatactctttaaaacttgttttgatgattttttgcctaagccaacctcgataacaatcttctccatatatggagagattaaaataaaatcagctcctcctttttttggttcataacttaggctatatcctttctttttacaaaataagtatagataaaacgctacaacatcttctaataaagagccataacaaacatcatctatcacaactcccattttatgccataatgctgtctttataggaactgggaggaattttatcttttgggattttctaacctttttgtccattgaaccataaggatagattttaaataacaattcacacttttctaagacatcaactaaatttatcaaagttccttttgcgatttcaagggtatttgctaaactttcatagctgtatctctctccctttggattggctaatagatatagcaatttaaaggctttatctaacgtttccatgtcaaattctttcacttctctaacatccttataaataatcctctctaacattgtatagattttattataaacttccaattcatcatcttccaaagcaaagggtaaagaaccaatccttaaatattttttaacatcttcctctaagatttgggaataaactttggcatacacttttttgaagttgtctaagttgttatttaaaattacctcttcaaataggctttcaatcttgatattttttgttaaatataaatattctctaaaagtcattggataaataggtttatgcaatgccctccttgccaaatctggactttctctaagctttaaagcagatgaaccagtagctattataaaaatattggtggtgtcatagaggttttttaaaaccaaatcccaatgcctttcatactgaatttcatcaagcaataggattatcttctcttcgtatagattgataccaaagatttctgaataagcttttaaagcatccattaatttgatgtcgttaagttttaactcatccattgaaaagtataaaactctattaggctctatctttaatcttgcatagtgatagatttgagataaaagtgtagtttttcccaagcctctaagtccatacaagaggattaactcctttttatcattctcaatgtatttatcaaccttttcttttaaaatatcataatcaaatctcttcttctctttgttgtatcttgagagtattaaaggagtttttgcaatgtggtttaaaatatagtcattcaactgaaccataataccaccagtatagccatttgattgaaccaatatataaaggtatgggaaaactaaaaaagctctaatcattttaatacctaaaaaatagcaaaaatattagataattaaaattaaaaaaagttttttataactctgtccagcctaatgattttttaaggacttctgcattgacctttccagctctatagacttttccagttgtcatatcgttaattacaaccacagctggagcaaacattcctttgtcaatcttgtagaagtcgtaatcagcagctttaaacacttccatgaatggttttccataatcttttgaagcacaagatgggagagctttgcataagctttcaatgtcatcgttttcatcactcttaatgtagtagtaggttatcccaccatacaataccatatcgtttgtagctcccatcattgcgaaatcatcccctattattggagcaattggagctaaacctgccgcatatttaactttattaacatcaaactctaaaacttctaacatcttgtatgttccgttctcaacgactcttccactaatctggattgaaccaactaatgaagcagttggagcaactaacaaataaacgttttctacttcaacaccacattctttagctacatattcagcaacttcttcatttggcaattttgaagcctctaaacataaaacagcaacatcagcatcatcttcatagccaatctcttcataggtcttttttggctttttagctaaagcccttgcaggtcctgaacccatagcaaagtattttccaactttaactgcccatcctgccttttgagctcccaatgtagcaattgctggatgtgatgtctttatcttaacataaggtaaggttatgcctttacactcacatggtgataaggagatgccaacatgagctaaacctcccaaacaaatctttgtgaataactttccagctttccagcttccagggacattaactccacagtccaaaacagtagctccattttctaattttatgacgtcaatatttatctcttctttattttctatcattttatttacaatttctaatgcctttttatttacactcagcatcttatcaccaatggaacatgtagctttatatggggttctcccaacatggtcaattatagatatttaggcaatttcattaaaatattttccgttataatctactatataaatcacgttgggattgggtgtcatcagtttcccaaaggaaacctctacccctgtcgtggtaacccccgagccacccataatctctttaatattccctaaacctcttttaaaaatattatagcaaccaactaactgtctattaaaagagtttaaacaattagagcaataaacaacctgtccttcttgggactccattctactcccgcatataggacagattgttgatgtgtaggcaggattaaccaaaataacaattgttttataacttattttttcaattaggccattccaatttactctatctatttttctattgaagtatttgcttttatacattcttcttttatttaaatcctcaaaaacaaaaattgcatctggaaataatcgagatagttgaatagttagtttatgtaagaaatccttaaccctatttcttcttctttcgaacaacctatttatctttctcatagctctcaaaggaaactttttaagtaattttttaagaaaatcaatttttctatcataaacctccttaattcgatgtaattcagttaaatctactctagtccaaccttctatcggatgaaataagtcaagagaccttagattgctatccactccaacgatcatccctttatctgaatagtttaggttatctttgaaagttaaaaatgtttccttttcttttaaaataatttctccaatggttaaatttttaaccttatcaaaaaaccactcatttttaatatttagaattaggtagtcctttcttggttttatcgttatccgtatctctcctttttctttatcgtattttattagggttgtcttaactctaacgaatagcctttttgctatcggttttgttttagttctatagccccttttgtagttagacgcccaactttgcaggatagaataggaggtttttataatcccatcgatgtagtgagaagcataattccagttctctaagagtttgtttcttaactctcttttaaattcgtttgattttggtaattttggattatcttttttagtgtatttgatattattccaaatcatgtctatgcattcgtttaatttgttcttacactcaattaaaaaagctttaagtgggtagttatggctaactttgtaggatagaacgacttggtagagcaattctttattatcctttaattttgttttatttgacatattaatcgttattgtattttgtatgatattatactgttatatactcaaaaaagttttcctctatgttacatttgtttatagattaaacagttttggaaggtagataaatatatcttatataacttgtatttgtattgtttttatagtttatgatttaggttgatttaagcagagtaatcaaataactaaatgtgataatatggacatgaaggagtgggaaatattttacaataaaattatggaggattttggatttgataaagacaaagatgttgaaagtgcagtaatccttaataacattttagagaatgccaatacaatacctgttgataagcttaaagatattattgaaggtagagaagtttttatctttggtgcaggtccatcaataaaaaaacatatcaacattttaaaagaattaagggaaataaactataagaatcctataatagtggctgatggtgcatgtaaagcatttttagaagaaaatataattccagacattattgtctctgacttagatggagatttagaggcgttatttgagtgcaatagaaagggttctataattgtagttcatgcacatggagataatattgaaaaaattaaaaagtatgtcccaaaactaaaaaatgtcgttggaagttgtcaaataccaaattataaggagttaaatttgagaaatgtaatcaattttggcggatttacagatggagataggtgttgctttttagcctatcattttaaagctaaaaagttaatcttgggaggaatggattttggaatttatataactaaatattccagacctaatataaaagaggacatagcaataggggatgaaataaaaattaaaaagttggaatatgctaaaacattaataaattatttaaaggataaaatagagattgaatttttaaaataatttaggaaggtttatataccattctaaataagtaatagaagatatgccaatgtaagtgtgacgattataaaagaactaatttatacattaataaccaaatattacacgtgatgaatatgataaccgtaataggttttggttcttttggtagaaaagttgtaaatttcattaaaaataaagaaccaattacgattattgataaaaatattgatgatgctgatgatttagtaaaagaaggagtaactgtaattgttggagatgccactcaagatgaagtgttgaaaaaagctaaaattgagaatgcagatattgtattaatattaacaaatgaaccagaagttaatagaaggatagctgaaagagtttgtgagctaagtccaaactcatacaaaattgcaagagccattccaagatatccagaactttatatggggctaaatatagataagattataaacatcttagagagtggagctaaagacattgcaaaggaagttgaagatgcaaaattaaagagaaaattaatgcaattaaaatctgtgttaatagaaggaaagaaaagatgcatgaagttggaaaaaacagaagaagaaaaaaaagctcctcttctaatcttaacacatataaacccagaccctgatgctatagcaagtgccatggctttaaaaacacttgctgaaagatggggagttgattcagacattgcatatgggggaaatattggttatgatgaaaataaggcaatgataaatttgttagggataaaacttttaaatgttgaagatattgacttagataattactgtgtcattgcagtcatagatacatcaacatcaaaacaactacctattgaacttccaaacattgatataattatagaccatcacaacaacaccgatttaactgccaaatatatggatgttagaccagaagttggagccactgcttccattttaacacaatatcttatggaattggatatagagccatcaagaaacttagccactgccttattttatggaatccaatcagatactgactactttaaaagagaaacgtcaaaattggattttgaagcagcagcataccttcaaagctatatagatgcttctatcttaaatatgatagagaatccagaaatttcaacagaggttatggaagttttggctaaggcagtaatgaatagaagagtagttaaaggtaatattgccttagcttatgttggggaaataagtaatagagatgctctaccaaaagcagctgatttcttattaaagatggaagggatttcaacaacattcgtatttggtattgttggagatgaaattcacatatctgcaagaactaaggatttaaggttaaaccttggagagatattaaataaggcatttggtggaggaggacatcaaacagctgcagctgccaaaattcctttaggaatatttaaggcagtgtctgataaagaagctttaagaaaattagttgaagaggcaattagggctaagatattggaagttattggtataaaagaagaggagaaataattaaattaaataatttaaataataactttcttagattttttatgtcttttaaaatctaaggagcaagatacgttagagagatattttaaggctatttcttttgcttttaatattttatcttcatcaggtttttcagcattcaaattgttgttatattttacatatcctgtaattctataaggtaaatcccaattgcttaaaaacttagctattttttcaatttcatctaaatcaacaatatttggaattaagacagtatctatttcaaccttaaaattgaattcatccctatatttccctatataacttatacaatccaaaacttttttgttagagcatgaagttaaatatatatgtttattttcatcataagcctttaaatcaatatgtatctcatcaacttcaagcttatcaagcatatcttttaaataatatccatttgtagatagcataagataaaaaccctcatcttttaacagctttgttagttcagacaagtcattttgtaaagttggctctccaccagcaattaagattttatctaatttatagttctcattaacttctaaaattttatttaaaatctcatctacactatattttttacaggataatggtttaaagaagcagtatttacatttaaagttgcatccataagttaagagcgttatcttatcacttaaagatatatgggaaattagcattaaatcaccaaaaattttacttatacaacttctcagcatactccttagccattctctcagcatcaaagtattcaacaatatgattaacgcagttacaagctttcatccaccatctttcagtatcatacatgtcagcaacttcttctaataaattgtatatgcagttagccacataggcatcatcatccctaactccatcgccaattgtaaagctatcatccggatacattttagcccattctacatgccatccatctaaggtactcatgtgaatagaagcgttcatagaggcggtcattccagatgttccagatgcctcatgatttagttttggtgtgttaagccaaatatctgaaccctgctttaacatcttactcagctttagttcataaccagttagtatagtagctcctttcatatctcttgtctttgatacaatccaattaaaagtagctatcatgttgtggtcatttggatggggtttcccagcccaaataacctgtattcttttctttttcaacaactcaagtaatctcatctcatcatgaagcaatatatgaggtcttttataagctgtgaatcttcttgcccaaacaacagttagtctatcttttttaaaaatctttccagtttggtctgctacttcctcaaatagaatttcttttagttccatttttctctctctcaacatatcaatatcatatttttttgccgcctctctaataacagggtcttgccagtagtatttatcttgagcgttagttatagctactatttcacatctatccttaacccagctccacattctatcgcaaacttctttatgctttttagagacagcattggctcttttacaaactcttaatgcacaaactgtatagttaaatggatttcctcctaatttttcagctaattttacatcaacatttccaaagaatcccatggattttaataagttaatgtcttgggtttcatttccttctggtaaaggtgtgtgagttgtgaaaacagtatgttctcttgtgtattcaagcccatattcttctatcagcttaaagactaaaggtaaaggatgaggctcattcatgtggaagagctttacattttcacactctttgataactttatatcctccaattcctaaaacaatctgttgtgctatatgaagtatattgttggcatcatacaagttgtgagttatagttcttgagaaatcatcattttctggaatatctgttgttagaaaataaatagggcatgttccaaaaacatcttcttctaatttataagctttaacccaaacagtgttgttgtttattgtaactgggacttttaatttaatgtcttccaaaaaatcatagtattttcttatatattcaactttcatcttcccttctctgtctcttaattggtcataatatccatagctccataatattgaaactcctacaagaggttgattcaatcttttagccgctctaaaatgagaaccagctaaaaatcctaatcctccagcataagtttttaatggttggtgaattgcaaattccatacagaagtaggcagttggtttcattaatctcccccaattttatttttttaggattattcataataaatttttattaattgaaagacgccaaaatgaagttctttattttttaagtaatgccttaaaaataatatgaacttaatgaaatcaatctctttgccatactgtttatttaatataatccagccaacaatccatagtatgattattaaatatattacgaaaaataaaactacgactaaactaattaacattacaatccctcagaaatattcactgttgcatgaattaatatctattttatttatgtggtttattttttatgtttattccttatattccttaagttttattagttgtaaatatttggatattcaatttatatatggcaaaggtcttatacttagttgaaaataaaataagtaaaggaaaattatcaaattttaaaaatatttaagtatgtgattgttatggttcatgttgcatgctccgaaaatatgaaaaagtattttgaaaacattgttgatgaagttaaaaaaatttacagaatagctgaagagtgtagaaaaaaaggttttgacccaactgatgaagttgagattcctttagctgctgatatggctgatagagttgagggattggttgggccgaaaggagtagcagagagaattagagaattggttaaagagttaggtaaagaaccagctgcattggagatagctaaagaaattgttgaaggaaaatttggaaactttgataaggaaaaaaaggcagaacaggcagttagaactgcattagctgtattaactgaaggaattgttgctgctccattagagggaattgcagatgttaaaatcaaaaaaaacccagacggaactgaatatttagctatctattatgcaggacctataagaagtgctgggggaactgctcaagctctatctgtcttagttggagatttcgtaagaaaggcaatgggtttagatagatacaaaccaacagaggatgagattgagagatatgttgaggaggttgagctttaccaatcagaagttgggagttttcaatacaacccaacagcagatgagattagaacagctataagaaacatccctatagagattactggagaagctacagatgatgtggaagtttcagggcatagggatttgccaagggtagagacaaaccaactgaggggaggggctttattagttttggttgagggagttttattaaaagctcctaaaatattgaggcacgttgataaattaggaatagagggatgggactggcttaaagatttgatgagtaaaaaagaagaaaaagaggaggaaaaggatgaaaaagtagatgatgaagaaatagatgaagaggaagaagaaattagcggatactggagagatgttaaaatagaggcaaacaaaaagtttataagcgaagttattgctggaaggcctgtttttgcccatccatcaaaggttggtggatttaggttgagatatggaaggagtagaaacactggttttgctactcaaggatttcatcctgccttaatgtatttggtagatgagtttatggctgttggaacccagctaaaaactgaaaggccgggaaaagctacatgtgttgtgccggttgatagcattgaaccaccaattgtcaagctaaaaaatggagatgttattagagttgatacaatagagaaagctatggatgttagaaatagggttgaggaaattttattcttaggagatgttttggttaattatggggatttcttagagaataatcacccattattgccaagttgttggtgtgaggagtggtatgagaagatattgatagctaataatatagagtatgataaggattttataaagaacccaaagccagaggaagctgttaagtttgctttagaaacaaaaactccactacatccaagattcacctatcactggcatgatgttagtaaggaagatataatcctattaagaaattggttgttgaaaggaaaagaagatagccttgaaggaaaaaaagtttggattgttgatttagagatagaggaagataaaaaagctaaaagaatcttagaattaattggctgctgccacttagttagaaataaaaaggttataattgaggagtattaccctctactctactcactgggctttgatgttgaaaataaaaaggatttagttgaaaatatagagaaaatcttagagtcagccaaaaatagtatgcatcttataaacttattagctccgtttgaagttagaagaaacacttatgtatatgttggagcaaggatgggaaggccagagaaagcagcaccaagaaagatgaaacctccagttaatggtttattcccaataggtaatgctggagggcaagtgagattgataaacaaggcagttgaggaaaacaatacagatgatgttgatgtttcttacacaagatgtccaaattgtggaaaaatttcattatatagagtttgcccattctgtggaactaaggtagagttagataactttggaagaattaaagctccattaaaagattattggtatgccgctttaaagagattgggtataaacaagccaggagatgttaagtgtattaaagggatgacatccaagcagaagattgttgaaccattagaaaaagctatattgagggcgataaatgaggtttatgtctttaaagacggaactacaaggtttgattgcacagatgtgccagtaacccactttaaaccaaatgagataaacgttactgttgaaaaattgagagagcttggctatgataaagatatttatggcaatgagttagttgatggggagcaggtcgttgagctaaaaccacaagatgttatcatcccagagagttgtgcagagtattttgttaaggtagctaattttatagatgatttattggagaagttttataaagttgaaaggttttacaacgtaaagaaaaaagaggatttaattgggcatttagtcattggaatggctccccacacatctgctggaatggttggaagaataattggttatacaaaagcaaatgttggttatgctcatccttatttccatgctgcaaagagaagaaactgtgacggggacgaagattctttctttttgctattagacgcgtttttgaacttctccaaaaaattcctaccagataagagaggaggacagatggatgccccattagtcttaacaaccatattagacccaaaggaagttgatggagaagttcataatatggatacaatgtggagctatccattagagttttatgaaaaaaccttagaaatgccttcaccgaaagaagttaaggagtttatggagacagttgaagatagattaggaaagccagagcagtatgaaggtattggctatactcacgaaacatcaagaattgacttagggccgaaggtttgtgcttataaaacattaggttcaatgttagaaaaaaccacttcccaattatcagttgctaagaaaattagggctacagatgaaagagatgttgctgagaaggttattcaatcccacttcatcccagatttaattgggaatttaagggctttctcaaggcaggcagttagatgtaaatgtggagctaagtatagaagaatacctttgaaagggaagtgtccaaaatgtggctctaatttaatattaactgtctcaaagggagctgttgagaagtatatggatgttgcagagaagatggctgaggaatataatgtaaatgattatataaaacaaagattaaagattattaaagaggggattaattcaatatttgaaaatgaaaaaagcagacaggttaagttgagtgacttctttaagataggataaatttttaaatttttctaaaaaagtggtggaactatgaaagtcattcccttagcttctgaaagcttgggggttaggtctttagcaacctatgttaaaacaaaggatgtggggattttaatagacccaggagttgccttagctccagatagatatggtttaaagccaaatgatatagaatttgaaaaattgagagagatgagaaataaaatcaacgactatgcgaaaaaatctaatgttataactatctcccattaccattacgaccactacactccattttttgatgatatatacttggaatcaaaggattatgctaaagaactatacaaagacaaaattctattaataaaacatccaactgagtttataaataaaagtcagatgaatagggcaaaaaaattcttagagagcgttaaagatattgcaaaaaagattgaatttgctgacaacaaaacatttaaatttgggaagacagaaataaaattttcccctccattcccacatggtagggatgataaattgggatatgtcttaataacaacagttaaagaggggaagtttaaatttatgcacacctctgatactcagggaataatatttgatgatattagagattacataattaaagaaaaacctaatctaatacttatgggaggcccgccaacatatttgatgcatagatatggaaaaaagaatttagaaaagacaaacgaaaacttaaaatatatagttgaaaatactggggctgaacttataattgaccaccatttattgagggataaaaagtttagagaaaagattaatgttgattttaaaacagttgctgaatttttaggagaaaagaatttattgttagaggcatatagaaaagagattaagcaaggaaaagatattaatgagttgtttggataatacatcaagaataagaataaagttattacggtataactaccaaatattttaacctcgatgatgaaagttacccccactgacctttttgggatgaagaaatcggcactgtctgagaggtattatttattaaaaaattttaagaggcatcatcgagcgtagcgagatgatgcatccctgggtataccaatagggcggtagccctatggttccggcactgtctgagaggcgttatttattaaatctttaaattttattatctttataattaaaaattattagggatttttatgtttgtagatgaggttataaacaatttaaaaggaaatgaatttctaaacaccactcttttaactaaaagtaataaaaataagctatattatgcagtaaaacagccagatggtaatataaaagtagttcttccctttgtttttgaaaataaaaattttttaaaactttctgaatataaggatggaatagaaggagctacacaaagagttattgaagagataaagcaggaaataattaagaaaaagagatttcttcctttagctggatattttggtagaatatataaagctctttatgaacctttaacagtagtcaattgtaatttaaatttgggttatgacttgtggaaagttgataaatacaactacatcgaaggagataaaatttatttaatgcttagaatgatttttaaagaaaaagacagtaaagaaattgttaaacaaatcaatgaactttgtaatgacttagataagttcattaaaaaaattccaattgatttattaattgatgaagctaaaaatataataaatcaaaaataccttagggacaagttggatgagcttggtttagtttgctttatagcaaataattcaaagccggcaaggaaatacactgaagttagaaggcattataggatagcagggcctaaagatgtaaatattccttttgaatgtccagaagaacttgaacctatagagatagagcttaaatatggtaaaaaagttaaaggattagggataaaaaagaaggagatatttataataaccggaagaaatgctcagggaaaaacaacccttctgcaggcaatagatagtgggagagacgaccatttaattggagatgggagggaatttataataaccactaaaagtttatctaaggcatcaactgggagtatggaaatgagtgggcaggatataagcctatttttccaaaaactccctccaggaattaaaggaagccctaaagcagtttatggaactgcctctggctcaatgtatatggcttatcagatacaaagagctataaaaaataaaactaagcttattttaatagatgaggataattcagcggttaatttattagttagtggtgtcttaagtaagtggtttgaaggagttaaatcgttggctgagataattatggaagatagagaaaaattaggagatagctcttttattatagttacaagttcgttggatttattaactgctttgggagatagggctatttacttagaagaccataaagctaaatatcttgacttaacttattttagggaggagttggggagatattatttagagttggcatctaagtttattggagtaaaaatacgggaatgaatttttgtcatagaaacacatttattttaaataatgaagtaaatattaattttgtatcgttatcaacatttaacatttaattctgattgggataattatgagcaaagagagcaaaataactctaattggtagtaaattagcaaagacgggaggagagtttatatacttaggcgagattgaagagtgtaaaaattgcaagtttaaaagactatgccatggaaatttggaagtaggaaggaaatataagatagtctcagttaggtcagcaaatcatccttgtatagttcatgagggaggagttaaggttgttgaagtagtgttagctgatttgacaattatgattgagtcaaaaaaggcacttgaaggagttgttttaaatcatgaaccaataacttgtgataactttgattgcgagtattatagtttttgcaattccgagggaataaaagaaggggaaaaatacaaaataaaacaggttttaaatgagaaaataaactgtccatttggaaactcattaaaaaaagttatagttgagttagttgaaaataaataattattttttaactatttcgcatcccccgggaggaagaactctcaaaatatcttcatcatcaattccgtaatctttaaatatctcttttaactctttaacaacctttcccttctccttatttgaaggttttaataaaacccacttaataaaactcttttgtaaagtttttggaggtgctgttgttatttttacatctccatcgtattcaataactccaacacctaattctaaaggtgtatttctataataatgcctctctcctctaattacaaatgcccctctttttaaatattccccactctcagctgtttttgatatctgctctggcttaacccagtaggtatctatagccccatatccaagcttccaagcccttgaatgagagacggagaatttagcaacctcttccaatgtctcttcatcaacctctttaccttgagtttttataactgtgaatggagccccttggatatctgcgtggaatacaatatcatctttatcagtatattttttgataataatctcgtttgttattgcatcttttccagcaataactaagaatccattaataacagtccatttaaatttctcataccactttctttccttcctaatttttttcttcatctgcatggattctttttctttcaactcttcctctcctttctttttaagctcttctatcttctttttagttagctcaatagcattttctattccttcaattttatttctcaactttttagccttttcatagtagctttcagcattttcaaatgcattttttcttatatctaaagaaactctttcttctataactttatcatcaacctcagattttaatctaataattatctctccaatattttcatttatattttcaatcaatcctaaaattggatgctctttattttctctaattatcttttttattcttgcccaatccattttttctcttgcctgccttatagcattcagcaattcttcaacaatttgatagtttgcataaattaaatcccctttaatttggtttttctctgcatcttctttatacttcttcaatgtctctaactgccttctcaatatattttcttgtctctcaatttctttctcaatttttgatttttcttttttaactacaacttttgttaaaaatttggcaaagtagtcatcaacagcctctaaaaagctgttatagtactttttctctaaacctttgtatttttttaaatcaataggcacaacgtcaaagtattcattatcctttaaaacaatctgtggctttctattgttaaaaatttcatcaaatagatttttagaagcttcaaagagctttttaatttcttcttcacttaaatctctctttttcttgtctatttcagctctttcacaaatctcttcagcgtaaagtcctccaataccaaagactcttgatattaatctaacgcattcaacccctttattattcaagaaataatctttaaaaacctcataggcgatagaaaactctaaattatatggatttagtggcttttgtggagggaatttgtatttttccttagggactatatttctcgtactccatctctcaaccctaagcggagctataattgtatcctcattatttaaaaatatgatatttccatccccaaacagctcagcaaccaatttataaatcccatctcttgtttcaaagtggaaaataactactctatcaaaatttacctgctcaatttttattaatttggcattttttaaatattttcttaataacatggcaaaagagggtggaagttttggtttttccctctcataatttgttaaagttatatacttatatttaccaatgcttataacaagctctctactcccgccctcaggaacatggatttttaatatcaactctctgttttgctcattatcaatcaaaaacgctttatctaatctaccgttaatgaggttttgtaattcatccacaacacagcacacatcaacattagttatctcactcttcataatctcaccagaaaatattatatttttctttaggatattttattattgtgataatatggagagggaagagtttttaaagtatttaagacaggggaaatatgataaattagctaagttaattaatagttattcagatattttaagttttttagatgagttatttacatctaacaaaaaagatgatgtaagaagagcattgttggttttaaaaaggttagataacgaggtaattgagagatatctatattatatcctcttaaatttaaatgaaaaaagaattatagccaaagaggcggaagaaatattaaagaaaataaccaacaaagagagtgttgaagaggcaatacttgaaattgcaaaaaaacctttggatgaaaaaatagtttatttattcctacaaaatatgaaagaaggaaatattttctttagagccatccttgaacatacaaaaagtaaaaacatggaagaaagtataaaaatcttattaaaaaattataattcagagatgatattaaaaatcttagctaataagttatattcctcagaaaaagatgagagggaacttacaataaatatattgttgaatatagttgattctttaactgacgaacaaaaaaatatcctaaggggtcatttaagtgtctccttattgggggatgaagataagaagctatatagaaaatttaaacagctatttgaaaaattggatattccagctgagttatcagatgagcaaataaaatcactactaaaatctcatggaaaaactaccctaaatataattttaagagaaaatatcaaacttcctgctaacttttacaatagagagtttttaaaagactttttatatactggggatgaagagaagcagtttgttggagttaaattaatatcattaaaaaaagattcaaaaaagaaggttgatttattatttagatttttaaattatggatatgggaaagcaaaaaccgctgccataagagaacttaagaagatagctcaaaataataatgagttaaaaaaatatatagaaaataaaacattgatgtatgcaaaaaagatgaatttaggattaaaaatatcatctctaagaatattaaaagaatttgcaaaaaaagagcatttagaatttttaattaatgaacataagcgattgaaagagttagtttataaattagaagaagagaaatttatgggaggatttagacatttgttaatgatggaagaggaaataaggaaatgcaatgttgccatgagattgatagaggagattgtagcagagatttgtttaaaaaatgatatccattataatgatttaaagatatctgaaaaacttggttatgaattttatagaacaatggaattaataggggttaaaaatctaaacctaatagatattcatgagtttttagaagatgttaaaagagatggagaacttataacttatttgtctgggattgtgattaacaacaataaaatagatgataatttagctaagaaaattttggaggtaactgaaaaggcagagatggaagataaagatgtattaaatgcaaacaaaattatgatttatgcatctttaaatagagttgataagattggagagattataaatatggcggaaggttattattcaaaattagcttttatcaatggggttaaaaagtttattgatgagaaattgttagatgaagaaaaaataaatttattaattccaaagattgctgaaatgatatactcaacaaagaaattaagactaatggctttggaattttttaaaaactacccaaatgagcttgttcttccaatattgattaatgaaattggtaattataggggagaggataaattaatgatagatgttatatcaaacgttatatttaaatatccgaataacatacatagtattagggagttgttgaatacagataagagaaactctgctttaaaaatactgcttaaagttagtgagaaaagaccagagcttttagaagattttatatatttgcttgctggaatgtatagttctgcaaatgaagaggataaaaagctaataaagaagattttgaaaaatattactactgaagaacaaaaattaatcttaaaaccgataattggggatttataacttccgttaccttcataggcataattaagaggcactgccgagcgtagcgaggtagtgcatccgttttgatcaaccttttagtaaaaggttggatggctatgagaagggatgaatactttgaaaaattattagaagttattgaggagttaaagattgaagcagaggaaaaaccaattattgttgaaggaaagagagatgttgaaagcttagagaagttaggagttgaaggaacttttattataatagctaaaactcctatttatttaatagctgatgaacttgtaaggaaaagagttaaagaagttattctattaactgactttgatagaagaggcagaatgttggctaaagccataatagaggagtttagacatagaggaattaaagtaaatacaaaaattaggcatgagatatttatctatacaaatagtggtattagagatattgaaagcctattctcatatgtgaataaacgattattctgataaataaggaaaccgctaaattagtttttgatcaaccttttttctaaaaaggttgatagaaagcttattttcgtatgtaaataaaaggttattttaataaagagcaaatagattaattagtttaaagtaatcttaataactttttccttttaattttcttaaccatgttttcatgctctattttttcatgagttttttgtaaaatctcctttatgttatcaatataatataactttggtttcccacttacagactttataatcccctctttctctaatttgtttagtatgtggtaaagcttagtttgagacaagttcgttaattgcaataactctttagctgttagctgtttattaattagattaacaattacttctatctcatcatcttcaaaattgaaattttttaactcttctctccagtttatattactactttgcgataattcaaatataactccagtaaatgataaattattgtggaatcttattaagtcctttgctatggtttcgccataacttagccagccaatgcaattgtcctctataacatactcttcaacttttttacctgctttatagaaatttaggaaatatttaagaatatcttcttcaaactccctaaacattgagttttttagcacttctcttccataacattcatttataaatattagtggattttcaaaatcttcagccttttttagttcatcaacaattgattttacctgcttttcaatatccgttttcattaatacaaggaaacttccttctaatatatccctcctaaatactaaagtattttcttcaactctttccaagaaagcagtgatataattcccattaatgtccataaatccaagaggatgcactaagtaaaaatctaaacgccttaaatctctgtagaaatattttttaataatatccattggtagttttgtatattctgagagcatctctaaatatctttgataagctggctttccatctaattcataaactactttcccctcagctttagtaacccttgcatatatatctgttggctcatatccatgtccataaattaaatcgaactttaattttcctccaacaactccaaatacacagcaatctttaacaacctcccctttgtaaatttggaaaaacttatcaaatgaaccatcatctgcagcagtccctccgataattgggattgtaagttctctccctaaaacatctaatatctcctgctcactatctacattccaatcaaaaaacacgaatcctaaaaaattatcatctatatccaattttggatatttatctctgatacaggtttttattttatcggctatcttcttacctacatattcagcctccctatctactttttcacaagatattgcacttttgtaatactcatcaaaagctaatattaaaaccccatcttcttttatgtaatcttttccgctaaatgttcctcctgtagaacatccaatgagattatccaatggaatatgttgtttcattccatcaaatacctgttttagtttatctctctctaatattgacgttataaatattattaaagatgctcttcccacatttctttttatttcttctccaatttcaattccatcttttataggattttttatttttttgtgaatgtatatcattataatccccagatatatttagctttttcttagaaattaagaaaataaatactaaaaaatattgacttagcttaataaggacgtaataacttagtggtagctactattaataaatatattactattaaatatttatgtattatagtataaatcttgagacatgtgtttataatttaatataaccgtagttctcattacacatttaaatgtttttattcatttattgattcttttatgttgtatgttgtaagcgattgtgaagagtaaaagcttagcacttaaacctttcttgcttacagctcggatgtgccttgggaatgactctgccaatttggataagtttgtttcgattgcctttcttaatttattcagctctttatattttttagcttcttcattcggttttatcatgttttttctttttattgggatgaaataaacgcctccgagtttaaatagattttggagacctttatcaatatagcccttatctccgattattacacagtttttgaagtccctaatgatttctttataattttcctctaaaatatccttatcgtgctgatttgctggatttataaacagtaacattaaatacttcccatcggtaatgaaagttgctttatatccaaaataccaacattttttcgatggattgtaaccaatactactgtttttttaataagctttgaaattcctatcctctcatgtcgagttttcctcacaagctcttttgttttaattggcattgcatcgatgaacaacattttgggaatcggagcgaagcgaagagcaacgaaatcacaaagtgatttcgtctaataattgtaaatattcaattaaaaactcatatccacatttatacactcctgcaaaatatatcatgcataaaaccgaaaagattattaagtcgattagagagattatctctctaaggatatagggtgatttatactttgcaactatcggataaaacttagctcgcataagctttattaaacgcttaactctcggaatttttgattttttgataacgctatcacctccactattttttatcgatatattaaagttaagagtttatatatttatctatttgatgggaactaaggttataacgattttgataattttgttagctccatttattgcagagttttatataaataatcaaggacaatttatggacatttagatttagttgttaatgttttagtaattttaataattggatatataatggatatcatctctaatggcatattgggctttcaaaatcagaaatattttggaacaataaaattttgttaaaatttcttaattttggttttatctgcagtatttatctatatttatctatatttttggggtgcatgatgtttttgttccaacgtatgcatacacgttagtccagttttaatgattttaatttatgaatacatatttatcaaaaggatttttccagatttctttagagagaaatttttattttcaaaaaattaattagggatttattttcttatggattacccgttatgatgggtagtgctggaagtttggttttaggatatattgatggaatttacttaacttactttacaggttttaaatgctgttgctgattataggaatgttgctatgccaactgttaatattctaagttattttgccttttctgttgaagctgttttattcccaatgagttctgagttatgggagaagggttatagagaggcgttgggttatggtgttgagaaaatttgcctatattcttttgttttagttctaccaatagcaatattgatggcttagtttccagaagttattataaatttattctttaatgctttaatatttacatagccaagtttttaaaattcttccttctaaatacttttcataagctttaattattttaactttctttgtttttccaataaatttagctccatctttaacaacaaccatcaacccactatctggaagatagccaatagcatctcttttatttctaaagtgtctctctgatattataacctctaaaactcttccaatatattttttctttatctctaaatttattttattggctgtttccctaattagtagagaatatttcgtaatatttggtttaaagttttgaaatgcagacattggaaggggtctaaatttatagacggttattttatcaatataatttttaatcttatgcataaaattaactgtgttttttgctgtctcttcattttctcctggcaatccatagataaaataaacctgtgcctttaaattgtatttttttgctatctttacagcttttaaaacatcatctggtgtcgtaggtcttcctaatagtttgcagtgatttttatccccactctcacaaccaatataaattggggtttttagatatttgctaaatatctctgccactttctcattaaacaaatttgcttttatattctcaattaatacgtttgcgttatatttatcagctaaatctttacactttgataataaagattcaattgcttcataatttggttctggaaaataagggtttattaatttctctcctcttttataatctaaaaaatctggggctgataaaacaattctattgactccttcctttaataatgcctcaacttcttttaatatatcttcctcatccctacttcttgcatatccaaagacagaagggacagagcagaaaccacatcccggatttatatttaaagggcattttaatgttccattttcacataggttacattttttgttagtgcataataatagaggtcttttaaaattgctgcaacctctaacaacttcaacataaactctcgcagagaagtagtttttataatctttaatttcagttgagggagttattagctttaaatcagttaaaatttcccttaggggatttatttttaactcatcctcattataatcccaatatgttgttcctttaacatcttcagcatcaaaatccttttttattaattcccttattgttatctctccctctccaactatacttatatccgcctctattttttccaaaatgtttatgtcgttagctatagggcctccaacaattatcttactgtctgtttttaatctaattctttctactaattttttaacacatttaaagtcagaggtcattgcactaataaaaattaggttgtatttttttatatctttaatatctaagtcctctactggtgttatcttagcttcaataccttcactttgcaaaatacctttaactgttcttggcccagctccaataacgtcccttgctaaaattcttttcccatcaccagaggctaaacaatcaataattaatgctttcattttctcacttaacccataaatatctaaactaacaaaatattatttaggatgatatttaaattgggtggaaatttatggaaattatacatttaagtgaaattgattcaacaaacgactatgccaaagagttagcaaaagaagggaaaaggaattttattgtgttggctgataaacaaaataatgggaaaggaagatggggaagagtttggtattctgatgagggaggattatatttctcaatggtcttagattctaaactatataatccaaaagttatcaatttattagtccctatttgtattattgaggtattaaaaaactatgtagataaagaacttggtttaaagtttccaaatgatataatggttaaagtaaatgataattataaaaagcttgggggaatattaactgaactaactgatgattacatgattataggaattggaataaatgtaaataaccagataagaaatgagattagagaaatagcaatctctttaaaagaaattactgggaaagaacttgataaggtagagatacttagcaattttctaaaaacctttgaaagctacttagaaaaacttaaaaataaagaaatagatgactacgaaatattaaaaaaatataaaaaatactcaataaccattggaaagcaggtaaaaatcctcttatcaaacaatgaaattattacaggaaaagtttatgatatagactttgatggcattgtcttaggaactgaaaaaggcattgaaagaatcccttctggaatttgcatccatgtaagataaaaatttttggttgataaccatgaaaataataaaaactgaatatgacaaaattaagccttatattactaaagatggctcaataattagagaattactgcatccaaacatctataaaggtgtaaaacaaagtttagcagaagctatagttccagtcggctctaaaactttattacataaacattacacatctgaagagatatattatatcttagaaggaagagggttaatgactttagataatgaaaaatttgaagttaaaaaaggagatactatatatatccctccaaaaactccccataagattgaaaatataggtaatgtccctttaaagatattgtgctgtagttatcctccatattctcatgaagatacagaaatattagaatgaatttacttattattttattcttatcccaaaagcaaataaaaacatccagataatcatcaatattgctattaatacagatagaatcatcaaaccaggagaattcccaaagacaattggtataggtcctatcattacaattccagaatattccacactactttcagttttttcagtttctggtttttcgtaattttcttgagaacttggtagaatcattcctaaagttatcataaaaaatccaataaacattaaaataatccctaaaaatattaatattggcttcataatcatcccttttttaaaaattaaaaataaaatttagatttatttacccagtggataattcggagcttcgttagttataattatatcgtgaggatgactttcaacttgcccacttggtgttattattacgaatcttgccttttcttgcatttcttttaggtttttagctccacagtatcccattgaagctctcaaaccaccaattaattggaatactacttcacttacaggccctttataaggaacagctccctcaacaccctcaggaactaattttacatgtttcatgtggctttttgctggtgcttggaagtatctatcagccccagctccaactcctcctgtcattgctcctaatgaccccattcctctatactgcttgtacttccttccattgataaccattaactgcccaggagcttcatcagttccagctaacagtgagccaagcataaccgcatctgctccagctgctatagctttggcaatatctccactgtatcttattcctccatctgctataattggaacgttatgttctttagcaacatcagccacttcagcaacggctgttaattgaggaactcctactccagcaacaactcttgttgtgcagattgaacctggccctattccaacttttaaaacgtctgctccagctttaattaaatcctctgccgcttctttagttgctatattcccaactattaattttatgtcagtcccttctaacatctctttaaatttctttacattttcaacaaccctcatgttgtgggcatgagcacagtcaatggcaatggcatcaacctctgcttcaatcaatgccttagccctctcaaagtcatgtggtccgcaggcagcagcaactaacaatctaccttttttatcccttgcagcttgaggatactttcttctctttaaaatatctctcaaggttataataccaattagtctattttcatcatcaactataggtaatctttcaaccctatttgcatacatcaactctaaagcttcctcttcttcaacatcttccttagcacaaacgacatctttagtcattacatctttaaccttctttgttttatcttcaatggctttaacatctctgtgtgttataatcccaactaatttatcttcattatcaacaactggtaatccgctgatggagtatgtttccattacatttattgcctctccaacagtatcatctggagatacggtgataacatccttaataactacttcatcagcttttttaactgcctgaacttgatgaacttgttcctctatggacatgtttctatgtataactcctaaacctcctaatcttgctaaagcaatagccatctctttttctgttactgtatccattgccgcagaaactatagggatgtttaactttaaacccgctaagtctgtagaaacatcagtatcctttggctctacccatgaggcatttggaactaataaaacatcatcaaaagtatatgccttctttgcctcaattagtttttttaaaaacaaagtctcacctttataacctttttaactatatttagaagaggggtatttatactttttatatgatgcccttgagtatatgattatttaaatagtttatgaacttaacattaattcaataaaaaataaaataaagttaatatatgggggcatcaataatataaaaattgattgacaaaaaataaaataattatctagttctgcaatattctatgaaagttaggtgatgggatgatagacaaatcctcagaaattgcaagattttcaggtaaagggatattaattaccccaaaaactttagaaaaaccattgttaaagtgggaaaaactggaaataatactttataaagataaaattgtatttgaatttgtagataagacaattgaagtgggggtagaagatattgaagacgtgggggcagagttaccaaaaaaagtcattgatattgctaaatccacattggaagacatcacttaccactcatcaataatcatcaaatctaaagagtttggtaatgtaatggtggggtttgcaccagagacatcaatctatggaaaagctcctatagacaatttcttaagaaaactgttctatatcctgttaaataaaaaagaagtaaagatattgtataacgctggagaaaatagtgaaaatactaaatgggagaatggatttttaacatttattaaaaaacgtattaaggatgggttagtaacaaagatagaatacagattagttgttgagatattagacaatgaggattctaaaatatacgatatatttagcaatataaaagatgttgaaatagaagaaaaagatgtggatggagaaatagaacctgtgttaaagatactgcaggtaaaagatggaaaagatataatatcctacctctacactaaggataaaaaggtgagattatttatacttagatacatggtaatactgctggattacaaatatattggaattttacgttatcttcaggaaacggtggaatagatgaaactgggagtatcaacaagtttatttttagatactgataaaaacttatctgatgctcttgaaattttagaggagagggttaaatatgttgaattaggatgcgatggaaatttaaatgtaatgtctgacggaaatattgaattagctcaatcttatgatttaaaatatactctacactgccctataactgatttaaatttatcttcttatagagagaggataagaaaggttagcttagattttkttagagatgtcttagaagtggctataaaagttgatgccaaattaatagtcttacatcctggttattgtgtttttaaatatgattatgaaaaggcattaaactcattaataaagagcttaaacgatttaaacaacatccaagaagaatttggcgttcagataactattgaaaatatgccatcttacgatatgttcatgttcagaaacccagataaagagattattgaaaatttaggggagttgaaaattacattagatattggacactcttttttaaacaaaaatattgagaattttttaaaaatctctgataaaatagctcatatccacattcatgataacaacggagagttcgatgaacatctatgcattggcaaaggaaaaattaactttaataattttaaaaaagatttaaaaaagattaatgccataaagatgatagagttgcagaataaaagcattgatgatttagacttatgtatagataatttaaaagagattttgaggtaatagcatgatagaaaaagttttagagatggatgactggaaagcatacaaaattcctcatacagtagagattgatggcatggttgaggaaacaaaaacattaataattgagtttaaaaataaaaggaaggttttatcaacaagagaaggatttaaagaggttaaatatgtaggaaatcactcaatccctgttccattttgggacaaagttcataactacaaggactatgaaaatcaggttttaaataaaattggtattaaaaaggaagatatagcattgttatcaactggagcgaatatggataacttggcagttgcaaaggaagagtttgatgaattctatgtcgttgcttttacaactgcaggagctaagcataacgctataagattaggagatgaagaagctgattatattgaaaaggatttcaaaacctacaaaatagttgatggaaagattgtgcctaaggaagagatagggacagttaatatcattttaataacaaacgctaatctaaccgatggagctatggcaagggcaataataacaataactgaagctaaaactaacgctttccaagagctaaatataagaagcacaaaacatccagaacttcaagctactggaactggaacagataatatagttgttgttaaagggtttggtagtggagtagattacaccggaggacatacaaagatgggtgagatgatagcaaaggcagttaaaaggagtgtgattgaggcattaataaaacaggataagataaaaatttaattaaagagattttaagcaccaaatttctcatttcttccagttaagtccaataatattttcattacatgctctcccttaatccaatgtaaagctcctttagcacatgcaaattcgttaaactctgtaacatcatcaactctgacactctttccccagataactattggaatagggtctgctgagtggtctttcatctctattggtgttgaatggtctccagtcaaaacaaaataaacctcatccttatttatgtgctcaaatacataggcaagcatctcatctattttctccaaaacttcttttttaagttcatagttaccatcatggcttgcttcatcagcacctttaacattcactaaaacaaaatcatactcctttaaagcctcaactaaagctttagctttgcccatgaagtttgtcttcggtgttccagtagctccctcaacctctataacatccaaaccaatcatcttagccattccctttattaatccagttccacagatacaagcccctttcatgttgtatttttcagagaacttctctatctttggaacaactccagctcctcttggcagtattatgttagctggaggtaagcccttctttctcctctcctcatttattgggtggttgtttaacttttcataaacaatctttaataatttatttaaaatctctgctgttctctttgcctcttctgaatcatccaatggctttatctcgctaaccttaactccctcttcatgtgggtccccatcgctaactctgcatgataagccttctcctctcaaaactaaagctcctctatatcccttagaagatttaaagataactttaacaccatcaatctctaaaccatcaatctccttctctaactcttcagcttcttcagggcttattctcccagccctcctatctaaaacaacaaagttctcatcaacagtggcaaaattacatctaaatgctatatctccctcctttaaatctaagccaacaccaaaagcttctaaaggtcctctaccagtataaacctcgtaagggttgtagcctaagatagctaagtgggctgtgtcacttcctggccttataccaatatctatggcattcattaaaccgcaaatcccttccttggcaattttatccattgttggggtctttgcctcctttagaggggttaaacccttctcatttggtctgtctcctaatccatctataataaaaattacacactttccctttttcatctttctccctcatgcaattataaatccttcatctctttcatatcttttattctttttaccctcttcatcctcaatataaatactttctgttttatcatcttttgcaactataatatttgtatttattaaactttccttttttacttcatcatccttttcatattgcttttgtccatctttccgtctattatttttatcaaattccgatttagctaacaattcttttatataatattcaaaatcatataaaatgtttaaataacttgcataggcatcaaatggagtgtcaaaatggctgaaatagttatgaacactcatatcactaagccccttaatggattgataataaagattatcgcttgtctgtaagaccttatacatcttatatatttcatcaaatttattaagtttttttaatttgtttgagttctcttttataaatttaccaatatcttttagtttttcaaacgatattctttgcatcttattccctaaccatgcacttacatccctctcagtgtcagcccatgatatcgtggcaaattcatgcacgtaaatctctcctcttggctctaatctatcaacaacctcactgacattaacaacctctaaatgttcatgcttagctatctctataggcaaatatctcaaaaactcaaatattccagtttctttccagtgatgttctccaaatgtctcatagtccatatatatgtttataacttccccaggagttgaagctaaccaaatagcatatttatcagctgttaatggatattggtcccaatctcttgctgaaaatctaaagccaatgtcatcactcaacctataattccttaacagaattttcataccatctggtgattggtaaagatagtttggagacctccagcctaagattttctcaattccctcagtaaatatcgctttaaaccctaaatcttttgctatctttgcaattctgttgttgtatattagctcagtatttctaaacaccttggctttaaaaccaaatatttctttgtacatctttctatgcatctcaatatcttcaataaactcatcttcagtttcaaatagacttgttagtgagtgatgatatgtttcagctatcaactcaacattgccagtttttaccaaatccttaaataaatccaacacgtaatcattaaattccaaagcttgctctacaaaaaccccagtaattgaataattaactttaaaatcatattcatcaataagctccaatatcaactcatttgtaggaatgtagcatttattagccactttattaaaaacttctttatttaattttgtatctacatacttttcccataaagtatttccgttttggtttatctccttatttagcctatgtggttgatgcacctcaaaattaaacgttattaacatactctcatctcaaaaatttatttatggtattatgaccttatcattctcatacacataaatgaggaacattgcattgctccagcctaaaggcatagcggacattggcacacctaattctttatgaatttgctctggaaacagcccatcaaagctgtatttcatcacccaattaaacaacttcttagatttttgtagataaatatctgccccattatcatctttttcttttaaaaccttgtataaccttctataatacaaagaaagccataatgtggttataatccatggattgcctccaaagtaaatgtcttctggatatctcccaatccctccaaccttatatttgaaagctttttcaattgcttcggctgtttttatcattctctcatcatcaacatcaatcaaattgaaagggtaacttaaacccaatatgcttgtgtctatcgtcttgtctaaaggatttattgatttagcaaatctttcctcatcttccaaataaaatctctttggaacctcatgttttaaaaattctatggtttttccccaatccttaactttatcccttttattcactgccttactcatgctgtatgcacatttcaatccagcgtaagtagctcccattgtataagcaaatactccaaacctctcttcccacaaatcgaagcatggagtaaagtttaaagctaccaaccttaaataattagcagctttctctatagtgttccagtatctctcaacgaactttctatccccagttaatctgtaatgcacatccattgcccataatatggaaccaatttggtcagtctgtattgcagttaatcgtggttttccattaacataataattttgtagccatgaaccgtctgcattttgtatcttagacatgaattcaaaaaatctgtctggaatgttccttatgccaaataagtccaaagcaattgagatataacttccatctcttccccacacgtatctataatctggatgtagagatggagccgctataatccctccttccttatcacataacattaaaagtgtcattaaagcccttttagttatagaataaatcttattattttgcctaagctcaggatgtataaatctatttatctcccctataatatgtttccaataattcattgagagatttttaatgttttcactgttattcattataatctttagttgttcagttattattgaaaaatctccatcgaatctttgtggaagtatgtagatgttgaatgccaaacttcttttttcatcaatctttatattccatgatattgcactatcggttaataatccagaactctctttatgctccttcaatatcccattttctatgtctatgtaagcacttgttttactgtatctatttccacactgaaatgaatctattcttttatcacttccaatgcaaaaaatatattttccattatatttaacgatacaaccatcttctaagaatttaactgtatttgttattgggttttcaccaattctcaaattttcgtaaaaaaagagcttaaaatttaattttttatcgagtttattttttatatacactcttcttataagcacgttgtgagatactggcacaaaatctttaatggttaatataatcttatcatcttctaagatagttttaaatatgttcgtttcctcaatgtatttttgggttatatcccaatcatcatcccaatgccactttacttttttatcataaactgccaatgcagagtcaaagaaatgagtttcataaccaacttggggataaaaaaggtattcaatttccccataatctccaattttggctaataaactattgtttccaacgattccacccatataaatcacacgatatatttttttaatattctattgccttttgcgaaaaacctacaatattctttttatagccttcacagccatagggcttcgccctattggtacaggattttcacagctcttatacatataaggaattttgatgccaaaggcatctttattcgtcatagaattttatttctgtgaaagtcctgcgatacccactaacacctcttcgcttacgcttggaggtgtaattttatttacaataatctctttatagcattccagattaaaaagctctgcggttttaaaattccttcaataggatttaaaaataatatatttttcttaactaaatacacataaattggctttgctacttcactatcactaatttcataactatccttaaataattttaatgctttaacaatatcttcttttttaagttcaataacttcatctccaacttcaacctttggctttatataatccaagtcatttaagaaatacttcaacttttgagtggcatctttaagcataaagtccaaaatatcatttaaattttcatatcttaacttatcaataacttttattatcaaaactggttttccccctacataactatatatcaactctttttcatccttagggagttttttatttaaaatttctttagctaaaaaatctataaactttaaagccgtttgtttgtcaaagtcatccactaaaatataatcagctcttccctctaattctccagtcttataaacatattcaataaataaactatcagaacttaagcagaaaacatggcataaatgttggactttagttaaggcaactaagaattggaataaactccataataacttcctatttccgtttaaagttatctctttaatcatttgcaactcatcaaatattaaaattggttttttacctttttcgtttaattttgcaaataaatattctatatattgataaacatccgctgatttatcctttttattaaaaatcttatcaaaaaatggttttggtattttaatgggcatgcccaaatagtatttgctaatctcttcactacctttaaccaacaaatcagctaatgatttggcatattccctaaaatcgtctatttctgatttttcatccacttcaaataaacattcaataaaattatcaacgtttaaaatattccttgtcctaaaatcaataaaaaacggaatatacttagatatgtctaatctattaactactatttccctcattagagttgattttccactgtttaaagaaccatagataaaataaatattatttggttctccttcaataatagataggattttattaatttccttttctctattgaagaatttcataattccaccaaaaaaatatttaaaattatattattaacttacttcagcttaattacccactttttatcatcttttaacacaaatattttatcttctcttgccagccatccaatagccatctttacaatatttgagttataaccctcttttcttaagattttctctatctgggagagggatttttcccctccttctaataaatggtagatttttccagcagtttctcctatttttccccacatgtcttccatgttatccccccaaaaggtcttaaaataaacattatcgtcccatcatctccatagctattttataaacatttactgtctctttagctatattatcccaactatatttttcatacacatcctttttggcattattgactatatattctctaaatccccaatccgatagaaccctatccacaccccaggcaattgaatcgggattttttggatagacccaaatcccattgacctcatgctttataatttccattaagcccccaactgagctaacaactactggtgtgccagcagccattgcctctaaagcaactataccaaatggctcataaactgatggaattacaacaacatccgcagatttatagagtttttttaacgtatctccattaacaaatcctaaaaacactaccttatgcctaacaccaagctgatagcacaaatcttccaaataatccctcatatctccagaacctgcaataactaattttgcattatgtctttcaagaatttttggcattgctcttattaaatactctattcccttttgatatgttaatcttccaacaaataaaatcattttttcatcatcttgaactcctatactccttctaaagtttatcttctcctcccaacttaaattaatatcaaattcccatggatttattccattgtagataactttaactttatcttcgggagtattaaatatagagcaaacttcttcctttaaagatttacttacggttattacttgacaggattcgtaagttgaaaggtattccattgcatgaatagcttttgagtcatctgaataaagccccccacaccttccaatttcagtgctgtgtattgattgaacatacggcattctgcagatatgtttcaaattagctccaacaaagtgcgtcatccaatcatgacaatgaataacgtcatatttatctactcctaaaattcctaactttttttccatctcttcagccataaacatagcccaagttaaaaaatgtggatgagatattggtcttactctataaacattcaccccatttatgttctcatactcaggcaagtcatagccaactgttataacatctacttcatgcccattcctaaccaatccctcagctaagcccttacaatgaattgccagccctccaacaattcttgggggatattcccaagttaccatagcaattttcataatatcatcatttagatttttaaatatagtataaatcttagaaaggtataaaaactatctaatagatactttaaattagataatataaaaacattgtgatatatgtacatcataatataatatttattgttaaaatctgaaattgaaattgctttaaaggggtaattatgaaaatagtcatccttgctccaacaataacccctattgtctcttatggaggattaggggatgtaatgagagacttgccaaaatttttaaaaaaaggtaatgaagtagttgttctaactctaaaccattataataggtattttactcttccctatgaagatatcaaaaaaataactgttatctataaaggagctaaaattacatttgatgttttaagaacaaagcatccaacgacaggagtagatttaattgtatttagtaatgaaagtgtcaataacttaaatgtttgggaccctattaagtatgaaatttttgctgatttggttattacatatttagatgaggttaaagatattgatgtagtgtctgggcatgattggatgtgtggtttagctatagccaaatgcaacgatattttagatttaccaacaaccttaaccatacataatgaggcatttaaaggagagatgattgagtataaaggggaagttatgacatttttggagttaggaattaagtatgcagatgccgttaatacagtaagcccttctcatgctgaggaaataaaaaactacccttatataaaaaaatacttaaataataagccattctgtgggattttaaatggaattgatattgatgaatacgaccccatgaagataatagaaaggatgtgcaacctctcaaacaacaaacttgacccaagaaattatgcttatatctctccctattcagctgaagattcccataatataaaaccaaaaataaaatattcatggttttatagaggaggagtttatgaatatgtggaagattggaataagattgataaaggaatatcagctactgatgttgaggtccatggtggggtagatggagatatagaaactccattaattggttttgttggaagggcgacacatcaaaaaggttttaacaccatgtttgaagcaattccagaacttttagaaaaacatgatataagatttgtatttttaacaaagggggatagagatattgaagagagactaaaaaatcttgcaaatgaacatgatggaagaatcttggcattgataggctattccctcccactctcatctttagtatttgctgggagtgattggataattatgccttcatactgggaaccgtgtggtttagtgcaaatggaagctatggcatactgcactccagtcatagctacagaaactggaggtttaaaagataccataattcctcttcatccaaatccttatgaacatccaaattttgataaggcaacgggtgttttatttaaagttccagataaagtggggtttatgtggggggttgagcacgcattaaattggacattctataaacttaatgaaatatgtatgtttatgcagtatataagatataaatgccctaaacatccttatgatgagaactccccattatctatgatgatgaaaaactgctactatcacgtgtttagaaacttaagctggcagaactccccatctataagaaagtataagggcttatttggaggagcaatttataatcactatctacaaccataactttccactttatgtaataaaagatttggggggaaatatgctaagttatgattacgaaaacgctttaaaagttggagaaataagccttgaagatatcaataaagtagattttgcaaatgcatattcaaacttgatggagaaattggataatggagttgtaggatttagagatgttatttatgatgagaacttagataaatataaatctttaaatggatatgaaaatgttgtagttattggaatgggaggctccatattgggaacaatggctatttattatgcaatttcaccatttaacaataatgcctattttatagacaacagcgaccctgaaaaaaccctctcaatactaaaaaaagttgatttaaacgaatctataatttatattattagtaaatctggcaacacattggaaactttggttaattattatctaattaaaaaaagaattgaaaaattaaattcatttaaaggaaaacttgtttttattactaatggtgggaaattaaagagagaggcagagaaaaataactatgatatattttcaattcctgaaaatgtccctggaaggttttcagtctttactgctgttggtttagctcctttatattctttaggagttgatatatcaaaaatattagaaggagcaagagagatggacaaaatctgtcaaaatgaagatattttaaaaaatcctgcacttttaaatggggttatacactacctatatgataagagaggaaaggacatctcagttattatgagttatgttgaaagcttaaaatattttggagattggtataaacaacttattggagaaagtttgggaaaaaataagcatggaataactcctttattatcaattggagccaaagaccaacattctttattgcagttgtatatggatgggaagaaagacaagattataacattcatggttgctaaaaaatataggttagatgaagaaatagaatttgaagacataaatgatgagaaaatttcttgcagatattcagatataattaggagccaacaaaaagctacagagatagctttaacaaataatggagtcccaaatgtaagaataacccttgatgaaataaatgagatggctatgggggctttactatacatgtatgagatgcaagttggttttatgggggagctttacaatataaacgcctacaatcaaccagcagttgaagaggagaaaaaaatttgctggagattgattaaacaataaataatatttctaattctttttctttattagtagatatcttaaaatgtgtgatattatggaaataaaaaaatttattgagacaataaaaggaactaagcttttcacagcatataatacaaatgtagatgcaataaaatatttaaaagacgaagatgtacaaaaattggtagatgaatttaaccataaagatataatagaaagaatggaagaatatccaagaattattgaagaaccgttagatttcgttgcaaggttagttcatagtataaagacgggaaaaccggcagaggttccaataaaggatgataaaaagttacatgagtggtttgatagaattaaatatgatgaggaaagaatgggaggacaggcagggattgtttctaatttaatggctaccctgcagatagataaaataattgtttatactccatttttatcaaaaaaacaggcagagatgtttgttgattatgataatttgctttatccattagttgaaaatggaaatcttgtattaaaaaaagttagagaggcatatagagatgacccaataaagataaacaggatattcgaattcaaaaaagggttaaagtttaagttaaatggagaggaaataactgctaagcaatctacaagatttattgttgcctcaagacctgaagctttgaggattgagataaaagatgatgttaggaaatttctgccgaagattggagaggctgtggattgtgcatttttatctggttatcaggcaattaaagaggaatatagagatgggaaaacagcaaaatattactttgagagggctgaagaggatataaaattattaaaaaagaataaaaacatcaaaacccacttggaatttgcctccatatcaaatatagagattagaaagatggttgttgattatattttaagtaacgtggaaagcgtaggaatggatgaaacagagatagctaatgttttgcatatcttgggctatgatgagttaagcaataatattttaaaagacagttttattgaggatgtgattgaaggggctaagatattactggataaatttaaaaacttggaggttgttcaagttcatacaatatattatattttgtttgtttgtagggctgataatccactatctaaagaagaacttgaagaatgtttagaattctctactatcttggcatcaacaaaggcaaaacttggaaatataagggcaatagatgatttacatgaaggtttaaaaatccctcacaataaatatggggatttattaaaggagattgctgagaaatttaacgataataattataaaatagctttatctccatcaagatatgttgaaaaaccaaaatctacagtaggtttaggagatacaatatcaagtggggcgtttgtttattatgtatctctattaaataaaaaaagaatgagctaaaaactaattttttattttttaagtgtttttactccttttttagttccaactaaaaccttatctacctttgtaaagataccattttcaactactccaggaatgttattaatttctttctcaagttctatagcgtcatctatgttcataaatacatcaataatcatatttccgttgtctgttataacaggtcctctttttctgtctcctaatctaattactgcctctcctcccatttctgataaagctcttattacaaccctataagctgaaggaataacttccacagggattgggaacttttcccctaattttttaactaatttactttcatcaactaaaacaacaaattcatttgcgttgtaatcaactattttttcttgagtatggcagcctccacctccttttattaaaaagagagttgtttcctcaacttcatcagctccatcaaaggcaatatcaacatcgtactcatctaatgtaactaatggaatttcatactgcatagccagcattttagcttcaaatgatgttggaattccgaagactgttagctcctcttctctaattctatttccaagttctctgatgaataaagctgctgttgaaccggttcctaatccaataaccattccatctttaactaacttcactgcttccttagctacttttaattttaaatcttcatttgacactatatccctcttttctggctttgtggttgttattgaaatattacaggactttcacagaggataagatattatttaatgtaaaaagatgcctttggcatcaaaattccaaactcaatatatagactgtgaaagtcctgtattaagaatgttataaaaagtttttgtaatttatagatttaaatatataaatataatgaagaaaaagaaaataatattatttttgtgttttatcccgaattggtctgattttaattatagggattatggttggagtttcgatgattatattacaattatttccattccgaaacggtcttattttaattttttgtatcgatgtattgggatttattaatgattgcgatttccattccgaaacggtcttattttaataaatgtccatttactgatacttctaccttatcaatatgtgtatttccattccgaaacggtctgattttaattttacaagaaaaaatattcaagattatctaagcttaattaaaatttccattccgaaacggtcttattttaataagaaaggacaatagtgttttttggggtgaaaactatttccattccgaaacggtcttattttaattcttcaaatacattatcaaatttaaaaaatgaaaatccctccaatttccattccgaaacggtcttattttaatgaggttcaattaaatgaagcagataaacatctgctgaaatatcatttccattccgaaacggtcttattttaatattaagattaatggtagctgtttgtgcagacggtagtttatttccattccgaaacggtcttattttaataacttcatgtcgtcatagttaaatacttcataaggaatttccattccgaaacggtcttattttaatctaataaatttcttatgaataaatgcatctctcaacatcttttatttccattccgaaacggtcttattttaatctgccaaagcatcaatctctgacttatatttcccaatttccattccgaaacggtcttattttaataaactgtgtttttagtcaataaagacgaaccatttacgatttccattccgaaacggtcttattttaatagggcaatcattcacaacataatatacttcaactctcccaatatttaagcttttctataccatatttttctaagggtaagtaactactccataatataaaccctttagtatttaaatctttctttccataataaaacagagtatttttatctttttaaatccaaaaatttaacttatttgttagagaaattttatttacttgcctaattaatcctaatttttaaaaatctgaataattcaataaactcaaatattctaaataatcaaaccagctaacccttagaaattaaatttaaaacctctaaataaataaataattcctaaatactctcatttctaaattccaaacttatacaacaagacaatcaataaatcaattaacaaaattgaaaatcccataaaaaccttaatagtaaaattctaaaatataatatctacggaacccatataaatatgtaacacaaaaaattaaattattttttagtagaattgtagatatggattaaatcacttaaaatagctgaagctgtttctataggtccagctcctcttccaacaactacaacctcttttgccaaatcagtttcaaacattgcaacgtttaaagttcccttgacatttaatgggctgtctattggaacaagcattggctcaacaattaaatagccatctttaatctgtccaattaattttattgtgtatcctcttttattagctaaaaatagagcttctggagttattctacttattcccttaacttttacatcttttattgttttattcatgcccataattgagtttgctaagataacaatctttgctgcagtgtctaaaccctcaatatcttgagttgggtctgtttcagctattccaagctctttagcctcttttaatgcagtttcaaaatctaaaccctctttctccatttttgttagtatgtagttggttgttccatttaaaattccccttattgataaaatttcatttcctgctaatgtctctttagccaagtttattattggcattgcccctccaactgaagcctcatgtctgaaaataactccatgtttttttgcctcttcaatcaactccttataacataaagctaacggtcctttattagctgttacaacgtgttttttatttttaaagctttctaatatatgagttttagctgggtctcctgtttctaagtttgatggtgttacttcaacaacaacatccgcatcaacttcttttataacatctattgaactcatctctcttcctttctctggataatttttaatctttccagttttttctttaacttctattgcttttagtaaatctaagccatcttcatctattgcagctccagagctatctgttatagcaacaaccttaaattcctcatagttcttttttaaataatcttttttatcatacaagaccttagcaattccttttcctatagctccaaatcctactataattatatccatcctctcaccaaaattttatttaaaatatggattttatgaataacaatcctttttctttttctaactcttcaaataagtaaaaaagctcctctatcttatcctcatcaacgataattctcatcattgctgatgattctttatctggatgtggcataatcaaatctaaatcttcaacaagtcctatctcatttattctgtctattgtgtctctcacgttggtatcaacaacgtgccctataacaacaacatctaaataaaccttcttatcttttccatctatttttttaattatagctccctctttttctaaatcttctaaaatcttttttaatttatctttatcatcaacatcaataacaatccttacaggaactttccctcctcttttttcctctcttgagtgaataatgcttattacattagccccgtattttgaaattggagttaaaactctcaacaattctccaggtttgtcttttaactcaatatctattgtaatcatattttaccaccacacatctttaatgcctaatttataggcaattatgtttccaagtagatgaacaaagacagtaaataaacagattataattatcatctcatagggtattggagcaacaatataaccaaatgctaaagctcctataacaaagtcaagttggtctaataacggagctggctttcctctttcaatatttaaccttctttttataaagctacctactgcatcaccaacaatagccccgactgataaaaagaaagccaatataacatggtctaaaacagtgccataaaaatctaagctattaaaaatattaaaatctactaaaattccctgaattaatccaactaacgttccacataaaattccgaaaatgcaacctctatatgttactccattacctattaatctccttccatcaataaaattttttcccaaatctactggagtacctccgccaaatatacatgctgatgcatttgcaacataagctggcaatatataccaaagtgatgcaaacaacaacctataaaacatctgtctccccttacattaatttaactctatggtagttaaattatcctttatatataaaaatattattctgtgagaccatgaaatgttcaatctgtgttcatacctcaaaaacaaaaaagataattaactatgaagggaagccaatatgtgtagattgtttaacaatgttaaaatatcctccaaactttgagaagatgaaaaaagaggttgaagaaattttatataatttaaaaaaagagggaggaaaatatcattgcattttagcattttctggtggaaaagatagtgttttagcattaaaattattaaaagagaaatttaaattaaatccattatgtgttatggttgataataagtatatggctaaagaagccatagaaaacgctttaaatgtaacaaaacattatcaagtagatttaatgatattaaatagagattacacagatttatttgaagatgcaataaaaagaggagaaagtccttgtaggagatgctcaaggcttatattgagagaggtttggagagttactaaattgttgggattgaagtatataattactgggcatgagttacctttcggacactctgcaataagggagatgaaggaaggcataaaaatgataaggttattagcaccctataaatttaaagaagaggagaaatataaaatgttagaagatttaccttggaaaaaaccagatttgggtggttatacaacaaactgcttagttttaggagttgcattagagagattttatgataaatatgggtttagctttgagattgataggattgctacacttgttaggttgggtttgttatctaaagaaaaagctaagaaggaattggaaaaacctaaagttcctaaggagatttatgaagagttgagaagaagaggattgaagatataaaaaagagggatacttatgagcataatagcaataaatgaaaatggcttcttagataaaattaaaggaagaaatcctttatttacttgtgtaatttcatcaatagaaactaccttatcaattccaatatctggagtgcatagggatgttattaaatacacaccctctgcagatgttgagcttgttttttatggaaaatctctaactttaaaaactcctccaatagatgccactggctcaccaacacctgcaaccataacgagggcatgtgttgagctaaagaatataaaaaacctccacatagatgcgggagcttttgttaagccaaagattccttttatagagatagatgaaaagccaactgggagaatagaagaaggtaaagcaatgaataactcaaaggaattatatatgaaaggttatctcttaggtaaaaacttagatgctgaattattaattgttggggagagtgttcctggtgggacaacaacagcattaggggttttattaggattaggatatgatgccgagggaaaggttagctctggctctataaataacccccatgagttaaaaataaaggttgttagagagggtttaaagaaagctggcattaatgaaaaatcatctgtctttgatgttttaaatgccgttggagataagatgatgcctgttgttgctggtttggctataagttttgctgaaagaaataagccagttattttagctggaggaacacagatgagtgctgtcttagcagttataaaagagattaacaaaaaggttttagataaaaacttaatagccataggaacaactgaatttgttttaaatgataaaaaaggagatttaaagggaatagttgagcagataggaaatgttccagttttagcatctaagttttattttgaaaaagcaaagattgagggattaaaaaattattgcaaaggttcagtaaaagaaggagtaggggctggaggaatagcagtttatagtatagttaatgatttggaaccaacgaaaataagggagtttatagaaaataagttttatgagtggtataaagaataaagcaatttatttttaaaattttcaaataaaataattattattgtaatgctattttcaataatttctatttttcaaggatttcggtttaactaaaaaatcgtatctgaaaatggtatttcgtgtttccattccgaatcggtctgattttaaccacaaaagaagagtatgaagttttaaacggattgttccagtttccataccgaatcggtcttattttaattgcaaaaattttggtttggcattggagggtttatttattttcatttccatcctccaagaggtctgattttaacttcttaaaacagccacaagttaaacattggtttatttcgtttccatcctccaagaggtctgattttaacttattgtgttattgtcaatttccatattccccaccaaaaaatttccatcctccaagaggtctgattttaacagaaaatgaagtaaaagagctaaaaaagtgcttatgtttccatcctccaagaggtctgattttaacggtctgattttaagaaaaaaaattaagataataaaaacatttccatcctccaagaggtctgattttaactaggttaaaaattctgacttttctagtccagatgtgcttacagcatttccatcctccaagaggtctgattttaacagggcaatcattcacaacataatatacttcatcactcttaatatttaagcttttctataccatatttttctaaggataaataaccatcttacaatataaaccttttagtatttaaaattttatctctttactaaaactaagcatttttatctttttaaatccaaaaatttaacttgtctgttagagaaatcttatttcctttcctaattaatcttaatttttaaaaatctgaataattcaataaactcaaatattctaaataatcaaaccagcaaacccttagaaattaaataaaaatcctttgaactaattaataacttctaaatactcttattttcaaatttcaaacatattcaacaagacaatccattaaccaaacaacaaaatcaaaaatcctaaaacccaaataataaaattctaaaatataatatctacgaactcatataaatatataatgacgcaaaaaataaattattttagcatattaatagaatcttagatatttaaatccatctccctcatcaaaactgtaatgaatagtgctgtactccttagcaaattctttaacatcctctctaactttctctggtttttctttatcaatagctatccttttcataaattcagctatttcttccatctctttttctttcattcctaatcttgtacattcttgtgttcctaacctaataccacttggattgtctgagttattaacatcatcccatggcaataagtttttatttaaaatgatatttgcctcttcatacatcttagctaactcacttgctgaaaactctatgtctggagaactctctatatcaataattacttgatggctttctgtaaagtccttgtgctcacataaaacattaaatcctctctcatacagagcctgagctaatgcctttgcattcttaataacttgcttagcataagcttctccaaactccaacatctcagctaaggcaatggctaaaccagccttatgatgtaaatgatggttactaacaacccctgggaatacatggctgtctatcttgtcagcgttttcttttgttgttaatataactcctccttgaggaccaaagaatgttttatgagtgctacccattaaatactccgccccttctctcaatgggtcttggaactgctttccagctattaatcccaaaacatgagctccatcataggcaattttagcaccaacttcttgagcagcttcataggcatcagctactggatgagggaatgggaataaagaacctccaaacaatattagctttggcttctcttctaagatttttttaaccattgcatcagcatcaatattcatctcttctgggtcgaatggatggtttataacttttaatcctctaattccagcagcacttactttccaatggcttatatgcccaccatctggaacacttaaagccattaatttatcccctggctttgtttcagcaaagaaaacagctaaattagcaacgacaccacttgttggctgaacgtttgcgtgttcagctttaaataattctttagacaactctatacagagtgtttcaacttcatctatatatttacatccttggtataatctttttcctggtaatccctcagcatatctatgcataaaatctgttgcacacgcctctctaactgctaaacttgttatattctcacttgcaattaattttatgctctctctcatccactcgtgctgttttattgaaacgtccctaataaactttggaacatccgaatattccatttttatccctcttattaacgtttaatagaaatagaaacaataaatataccgtattaatacttaaaaatatctttaaactatactgtcttcaaaattaattaaagtttattaataaatatttgacaataaatatttaaatgccttcctttggaaggtgttcataagctactggttacttcaaaatgtttttgaaagacactatataaaaaagtttttggtgctgtctatgatgaaggtgtgtgttatagaaggggatggaataggaaaagaagtgattccagaggccatnaaaatattaaatgagttgggagagtttgaaataataaaaggagaggcaggattagaatgtttaaaaaaatatggtaatgcacttccagaggatacaatagaaaaagctaaagaggcagatattattttgtttggggctataacctcaccaaagccaggggaagttcaaaattataaaagccctataataacgttgaggaagatgtttcatttatatgcaaatgtaagaccaataaacaactttggaattggacaattaattgggaaaattgcagattatgaattcttaaatgctaagaatattgatatagttattataagagagaatacggaagatttatatgttggtagagagagattagaaaatgatacagcaatagctgagagggttataacaagaaagggtagcgagagaataataagatttgcatttgaatatgctataaaaaataataggaaaaaggtatcttgcatccataaagctaatgttttaagaataactgatggtttattcttagaggtttttaatgaaataaaaaaacattataatatagaggcagatgattatttagttgattcaacagctatgaacttaataaaacatcctgaaaaatttgatgttattgttacaacaaacatgtttggggatattttatcagatgaggcatctgcattaattggaggacttggtttagctccttcagcaaatataggagatgataaagcattatttgagccagttcatggttcagctccagatatagctgggaaaggtatagcaaatccaatggcatctatattaagtattgctatgctttttgattatattggagagaaagaaaagggagatttgattagagaggcagtgaaatactgcttaataaacaaaaaagttactcctgacttgggaggggatttaaagacaaaagatgttggagacgaaattctaaattacattagaaagaagttaaagggatattgatgaaaataaagataactaaatccacaatattgttgataattagctttttatttattttagcaataatggcatatattggcttagataaaataataaaagttcttatcaatacaaacccagaatatgtaattcttgcttttatacttcaaatactggtttctgtaattctctcagcaagatggaaatttataattaagattttaggttattctgcaaattttaaaaatatctttttactcgttttaatgggattgtttattaacaatataactccatctatgagagggggaggagaggcatttagagcttattatttatcaaaacttgaagagattccaaaaggtttggcattttctacagttgtagttgaaagagttttagatacagcgatatttttatttttcacattatttgttattggatactttgtagttactggatttaagtatcttgagtatcttatactatcttggatttttttattttctctaactgcaataattatctatttaattgcaaataaaggacttctaattaagacggttaccaaaatatcaaagtttatctgtaaatattgctcatataattatgatgagacaaaaatcctacaatctattgaagagttttacaacagtatgaaattttttaaaaataagagaggatgggaggttgttgtagccatatttttatcagttatgcggtatatcttcgatattttaaaattatggctgttatttttgtctctctcttatgttgtctcagttatttgtgtatctgcagtatatttaataaccctcctctctggtgttttatctataactccaagtggctttggaacagcagacacagttatgatactttctttctctgcttttaatattcctccttcagtcgctgcagcagttactttattagacagacttgtttcttacatactccctacaatccttggttatattgctatgttaattataaaaagagagattgataagaaaaaaggaaaataatttaatataatatctattaattatattttatttaatatactttaaaatctctctcaaatcccttttctctatacaaatatctgccttctcttttaaaattggcttagcacaaaaagctatcttcaaaccagcttttttaaacatacttatgtcattagctccatctcctacagcaacagtatcctccaaatttattccctcaattttagctatcttttccaaaatttctcccttagcattttcttttaaaacctctccctcaacatctccagttagttttccatctttaacaatcaatctatttgcaaaagcataatctaatcccaatttttctttaattttattaacagcaatatcaaaacctccactaacaacagcaacaacataacctctattttttaactctttaatagtctcttcagctccctctgttggtgttattcttttaatagctttttcaaccttttcaattggaaggtcttttaataaactaactctttttcttaaagattgctcaaaatttaatttcccttccattgcttctttagtaatttttttaacttcttcctcaactcccgcctctcttgcaatctcatcaattgtctcattattaaccaatgtgctatcaaaatcaaataaaataagctttttcttcttctccattcaatcaccaactttaaaaattttaaaattaagtaaattttaataaaaaagtttaataaaattaattattcaattttctcgacttttatctcataatcatgaataacagggtttgctaagagctttttacacatttcttcaacttcctctttaactttttcttcattttctccttccattattatatcaatcatcttgtatgtttggacttctttaacattattaaatcctaaaaagtttaaagctctctgtattgtccttccttctggatttagaactcctttttttaactttattataactgttgccttatacataatttcaccttattgctttataataatcccaatctctcagcgacaattctgtattttgcaataacatcccctaaatcctttctaaatacatccttatctaagacatctcgtgtctccttatcccacaatctcatagtatctgggcttatctcatctgcaactaataaattgccttccctatctttaccaatttcaattttgaaatcaactaatataatgcccttctcatcaaacaatttctttaatacttcattaacctttaaagcaatttctttaattttatttagctcctctcttgtagctaaacctaaagctacagcaatatcttcatttagcattgggtctccatactcatcatttttatagtcaaattgaacaattggaaatggcaattctttcccttcttcaaaaggatatcttctacacaaacttccagcagctatatttctaactataacctcaattggaattatctcaacttttttagctatcatgtatcttggttctatatactttatatagtgggttttgactccattttcctctaaagcctcaaataactttgatgagattagagcatttaagtaaccttttccttgtttgacatcatgcttagctccatttccagctgttatatcatctctaaactctatcaaaactttatcatcatcaatctcatagattgactttgcctttccactgtataatggctgtttttttagaatttcttctaattttatctccatactttcaccttagctataactttaaattttaattattaaaactctcatttaatttttaatctttatacttacaatgtaatataaaaaatttatagttcttttcaaatgttaataaagtttattaattaagtttgaactcccttcctaatggaaggagttcatcagtgccttagttattacaaaatattttaaaaagaactatagtcaaaacagtgaaataaaaaataaaaatatatcaaagatttcgatgtgcctcccttaaagggttcggcacatcgtaagaacgttataaaaactgcccagcaccgagttaatagcatatatatgtttgatattaaatttcaataactttaacatccttacttaaaactgctttaccttcaccttttttcacaactcttccaacttcaaaagcatagcatttagctttttccaactcatcaattaaattatctttatattcttcttttgctgatattaataagccaccagcagtttctgcaccataaccatccaataaagcatgtccaaataatctgcttaactctggagtcctttttatacaaggcagtaaatttatttctattaaaacattgctattcttagccatttcatttgaatgccccaatattccaaatccagttatgtcagttaaagcatttgctattttatctccaactctttcttcagcctttcttagagcttttaatgcatatctgtttgatgtagtcattatctctattgccttatttatgatgtagtctctttcttcttcagttatgctaattaaatccttaaactcctctgggattcttgataacgccatcgctgtttgagttcctaatggttttgttaatattaaaacatctcctaccttaactccagcctttgttaaaacctcctcctctcttccaacaccagtaactgctcctccaattaagggccatggatttagtattgtatgaccaccaactattgttgttttgttctctctgcagaagtcttgaaagccctttaacatctctctaactacgtgtattggaagcttctctggaataccaacaattgctaaaactcctactatatccaatagtcccatagcatagatgtcgcttgttgagttgcaagctgctatttttccctgtatgtatgggtcatcaactattggtgtaaagacatcaactgtctttgctataactaacccattcctcttaattattgatgcatcatctcctaaaccaaccaagatatttttgtccaataagtcatcatcagtaactattcctttaactaaaaactctaactcggtgctgggcagtttgcaagctcatccgtggagtttaactaattcagttagttttattttttcattacctctttccatactctcacctaaaagttataaatttataaacataccaaacaactacaattattagtaaatttgatagcttaataggacttatacagataatatttttatttattgaataatgatgcccaaagggccaaaaattaataactaaaattcctaatatgaaaccaataaactggactgtgagtttgctttaactcagtctctttatatataaaagtagttattaaagccccaataaatataccaacaacagttaaaacaggaaaagcttttgaaactagtgccattcctaatgtagtcccaaataaatgattaataatccaatttactaaatcccttgtgtgacatgctatacagataccataagctggtggagggaacactttaaacagtgcttgcaatattgcagcagtgaaaccacctatcaaccctgctattagtggagaaattctcatcgttttccatcattttagatttttttaatatggtttttgatagatgctaacatttatttaaaatttctaattataaaaagttttttgcaaaagaatctaataattatttagctattagaaaaattaattaggtgatttaaataggactttcacagtttttattatttgataaggcatttaggaatcaactttccttataaaagtctattcctgcgaaagccctattaaataaactttaaacaataaaaaagagataccaaacaactattacaattaaaaaagatatctcataaacaattaaatgtaaagtagctaactttgccccgatttttccaaatattgagagctgtattggtaaatactttctcaaataaagaacaactctatttaaaaacctgcgagaaataaagaaaagagaacttcatttggagacagtatattttcatctaaaagtccagatgcaatacctatagcccctgaaattgtagctaaccctgtaagcactataactaaaatagtaggagataaatttaaagcatttaataaagaaccagcaaaatcctcaacaatatccaataaaccatgctcaataagataagttattatcaaaacagatgggacaaatgatgttaaaactctaaaatactgcttaaacgtatctcttatagctccatataaaccttctgacttagatttaaattcaatatcaatattgtatttcctttttttaagcattaaaacacttataatcaaataattgcatgttaccaaaaattttattagcacatagatgcctccaacataccaacccaaacttgtagccattggtatagcataaaataaaattatgtggattccaaatacaaacatccctaaaaagtaaattggcaaaagattttcttctgaaatttcacctttttttaataaattttttaataaaaagctacctgatgttgaactaacaaaaaagacagcaattattgggaagtatttattttttatatatttttgaagtttgtataagatatttaaatgacacataagatttgctaaaagaattccaaaaaacattattggaagtatctttataaatatctgcaatgccatcatcatgttctcaaactaatagttttttgcaaaaaactattaaacttctttcattttttcctttgctttctttttaaggtaataattacctaaaaatccggaaactattggaaggggagttaatatataaataaatcctccaaaaactcctaaaatctttttataaagttttattgaatcaattgtattatctcctatcctaaaaattaaagattttattaacttcttttctgacgtatagacaaccttataactccataatattgcttgatacaaaggtgttggctttccttcataagtcgttctttttttaactattgccttatacaaatcatcagctgaatttccctcaaataatgtataggcattccctaccatcctcgctatgtgagcatcactccctccaataaatgcaaaaggctttttgtggtagttcctttataaccttatttaatgctatattattaactattccatccctatggtaggcattaaaaacctcaactccatccaaatctaagtcaaatattcggtctccaagtgctttacagatggggctgtagggatggggagctatagctaatcctccttgttctttaattttttctatagtttcctctggagataaacctttaggtatatcttcatttaaaaataaaccaattatttccccttcggtagtcataatctcgctacctataacaacttcaactccaaactctttctccaatttttttgtctcaacccctcccctaattgtattatggtcagttattgctacaacctcaatgccttttttcttagctactttcaatatatttcttggctcttcaacagaatcagggaatttaagtttccaaaatttaccaattccagaatattttgtgtgtatgtgcaaatctgccttcataatccctcctattatttgtctttaaatatttttccttgaataaataatttaatagtttcattgaaagatttttaagacattagggattttttcaatcaaatctaatggggtataataataacctttctcttttaacagcaaatctccagcatagccgtttataaaagctccacaacatgctgataaaaatgcctcattaacagcaaataaagccccaattaaaccagctaaaacatctccagttcctccctttgtcaaaccagcatttccagttttgtttatttttagattgttggcattaaatattatatcatatttcccttttaacacaatcgttgattttatattttcaatgttatctaaatcaatccccatatattcaaactctcttttgtgaggagtgaaaatataattctcagagaattcaaagttattataatcaataactttaattgcatcagcatcaataaccacttttccatcatattttgctaagaactcatttaaaaatgctttagttctattgttggctcctaagccattaccaagaacaacaacatcatactttttagcaatttctagagtataatcaacatgttgagagcttaaataatccccttcaaccctatacataataaactctggatgatttactttatctataaccttaccgactgacaaaatccccaccaaatcaacaatttttaatgctgccaaaccagccaatattggagctccataaaaatctttactacctccaataatcaaaacttttccattttgccctttgtggctattgctatctctcttccttagagcttttaaatctccccagccaactatgtattctgcctccttaggaatgccaatcttttttacaatggcgttgtctttgtttatagtctttctcttgtggaaagttatagttaaatcgctttctaaatgccctgtctcaacatctacacttataacaaagatatttttgtttatttgctttaactcgtttattttatcaactatggttttaaatggctctcttagctctcctttaacaccagttccaatcattgcatctataataactgcctttttattttttagcctttcaaatatatcattaacttcctcagcccatttaatttctctaatccttatatttccaaactctgccaaattttttagtatcttaaagttttctcttgcctcgtaggtttttatctctgactcttttcctattaatataacatctccctttccaagatgtcttgctacaacaaacccatctcctccgttatttccagttccacagaaaatgataaattcctcagcatcaatatccttaatctcttcataaactgcctttccagcattctccattaataatattttttgaattcccaaaaactctgcattatcatcaataattgccatttcctttggtgttataacctctttttctttaattttttgttttaatatttcaaataactccattctctcaccaaataggaaattattaatatcccttctcacataactatttttgtagttagtttcatatatttattgtggggatttttatgataaagaggttaaaaaagagagatgtaaaagtgccactaacagttccagaagacagaaaagaagaatacataaaaaactacttagaattaacaaaaagaactggaaatgtaatgctattcgctggagaccagaagattgaacatttaaatgacgacttctttggggaggggatagctaaggatgacgcatctccagaacatctgtttaatatagcaagtaaagggaaaatctgcggatttgcaacacaactcggattaatagcaagatatggaatggattataaaaaaattccctatattgtgaagattaactcaaaaactcatcttgttaaaacaagagacccaataagtagggctttagtgcatgttaaagatgttgttgatttaaaagaaaactctggattaaaaatattgggggttggttatacaatctatcctggaagtgagtatgaacatataatgtttgaagaggcatcaagggttatattagaagctcacaagcatggcttaatagcaataatctggagctatccaagagggaagaatgttaaagatgagaaagaccctcacttaattgctggagctgctggagttgccgcatgcttaggggctgattttgttaaagttaattatccaaagtgtgataatccagcagagaggtttaaagaggctgtcttagccgctggaagaactggagttctatgtgctggaggtaaaagtatagagccagaaaaatttttaaaacagatttgggagcaaattaatattagtggggcaagaggaaatgcaactggaagaaatatccaccaaaagcctttagatgccgctataaggatgtgtaatgcaatatatgcgataaccattgaagggaagagtttggaggaggctttaaagatatactatggagataggaaataaagtgatggagatgaaaaatgatattagtaaatggaaactcataaaaacattatacaaagttttaaaacttaaatgttggtatgatgatgaaaattacgcttggagtggaggtttatctgcttatgctgatggattgaggttgctgtcaaaagttggattgtttaagattgaaagtgaatattgtaggtcagtaactggaaaatttaaggaattaaaagcaagtgctgtaaatcttaatgcagtagatgaggatgagttaatagaaacgctatatagggtgttacgtcaaagttgtattatgaatatagatgataatattggagaaagttttggaaaaaaggtatatgcaagtggattaaggttattaagtaaattaggtttatttgaaattgaaagtgagcaaggagattatataattggaaaattcaaagaaatttaatttatatctttggacaatccaacttttctgaaaatatttttatatcaattattggtgtttcattgtaagcgtcaattttgtcaatgaaaattttatttctataaattttatgtatttttacagtgtattttccaatagggtttggtctgtagggagaacgggtagcaaaaactccttttaatgggttatttatatcccctcttggatgaacctttaaaatttttcgtttttcttcactgtcgtttttatgaaaccaaaccaaaacaataatgtaatctccctcctttaaaccatctaacccctctacaaactcatcaaatatatttaggactgtatagttctcattttgctctacaactccaatgggttttaaataatacattacaatctcctcttaaagaatttacatgtgtttttgtaaatgacatcttttacctcttcaacttccatctctttaatctttgctatctcctcaataaccaatttaacattctttggttcatttttagttcctttgattggagatagataagggctgtcagtctcagtagttaaatactctaaatctaagctttcaacaagttttttatgatgttctgaaaagcacaccaatgttgaaattgatattaaatgcccttcttttccaatctccttagctaactctacatcgccactatagcaatggaacataatatcaactttatctttggctatatcaaatatctttctctcaaatcctcttgcatgaacaactattggtttgttaagctcttcagctaaggacaaaaattttttaaatatttcttcttgcctcttatagttttcatctttgatgtccattccaatctctccaatagccaaaatctcatactcattatttttaattaggttataaaccttctctataactttatcatctgctttaactctcgaaggatgatagccaagggttagataaatattatatttctttctaagctctaaagctctcaaacaacctcctaagcttgctccacttgttactattataacgtcttctttcttagccctctcaatgacctcatctctgtttttgttgaatgctttatcttctatatggcagtgagcatcaacatatttcacatctctcaaaactattcaccttcattatcctcaattagcttctttaaaatggccattctcactggaattccataaaaactctgcttaaaatactttgcttgaggtaaatcatcaacatcataatcaatttcatcaactcttggtaatggatgcataattataaacttctttccttcgacatactctctctttatcttatagctacctttaaccttttcatattcgttagggtctggaaacctctccttctggattcttgttacatatagaacatctatatcatcatctaaatcatccaaactttctttttcataaaattttatatttttagcttttaaatcttcaataatatcttttggtagtctcaattcttttggagatacaaaatacatctcaacattttcaaataaggatagggcatagaccaaggaatgaactgtccttccatacttcaaatctccaacaaacgctatctttatcccatctatcctgccaatctctctcattattgtgtataaatccaaaagagtttgagtaggatgctgattactcccatccccagcatttataattggaacttgagaatattcacttgccaatcttgcagctccttcacttggatgccttaaaacaattatatcagcatatccactaattactctaattgtatctattaaactctctccctttgcaacagaagagctttttaaatcagtcattgttattacttctccacctaacctcttcattgccgtttcaaaactcaatcttgtccttgttgatggttcataaaaaacagttgctaatattttcccttccaataactttaaaggtctttttgtatttaaaagctcttccatctttcttgcttcatctaaaatctctaaaatctcctcttttccaatatccttcattgatattagatgcttcataattatccctattaaagcatatatatgaggtttgatagagtatttataaaaaagatttataaaaattttggagaaaatattgtgtgtctttcaagataataatttgctaatttacacctccgggcatagcgaggaggtgttagggtatcacaggactttcacagaaataaaattttatgattgaataaagatgcctttggcatcaaaattccttatatggtataaaaagctgtaaagtcctttgtcaatagggttttcccatgcttataaaaattttggaggaaaaacttatggaactaatccaaatagttggggttatatttgcattgtttgccttgtcaagggttgtgttgcagttaaaaagaagaagtataagctttaatgagggattattttggatttttgtctggggtttcgttgtaatatttttagtattcccagagttttttggatatgttgcagaagttttgggggttggtaggggagttgatgcacttatatatatatcgatagttgtcttattctatttaatttataggttgtatgccaaaataaacaacttagaaaggcagataacacatatagttagagaaatagctataagggatagatatgaaccaaagaaaagagattgaattgttgatgtttgatgttttgccttatatggcaaatatggagtttattaaagagcttttagaaagtgttaatagcttagaagagcttgaacagaaagttagagagttgttagagaaagaaaccgacattactaaaaaaactgatttaaagatactgcttgaaaaaatagaggagagaaaaaataagtaaaaaataaaaataaaaattttcttacttctttttcctgtattcatgttcaaaatctttatcaaaagtcagaatgaaacttttcaaaaaagtttcatcaaaattttttatggctttttctatattcatgctcaaaattcttatcgtagagtttagagtatgcataatactttggatttaaaacctctccaacaattattagtgcagtttttttaattccctctttttttaccttttcagctatatcctttaaagtccctctaactattttttcatcatcccatgaagcgtgataaacaacagccactggagtttcttctctatagccaccttcaattagctctttaacaaccttgtcaatcattgaaacgcctaaaaaaatagccattgttgattgatgcttagctaaatccctcaacttttctttttctggcattggagtccttccctctggtcttgtgataataactgtctgagaaacctctgggagagttagctcaacttttaatgaagcagttgctgcaaataaggagctaactcctggaattatctctacatctattccatatttagatagctcatcaatctgctcctttatagctccgtaaatagaagggtctcctgtgtgtaatctaacgactttctttccttgattaactgctttaaccatcacatcaattatttcctctaagttcatgtttgcactgttgtaaatttcagcattttttttgttatactctaagagcttttcattgactaatgaaccagcatagataattacatccgcctcttctatagcttttttacctttgattgttattagctcagggtctccaggacctgctccaacaattataacttttctattattatccattatttctcctcttgtttttgtttttatagtaggtctttcaaaattaataaaatttacttatgaaaattatctcgctcctcctcccccgccaccaaagcctcctcctgctccaaatcctccgccagagcctgttgttgatgaatatacactatctacagaagttttcattgaatcatagtttgagtgaattattacatagtcagcaaccaattcagagaggtttaacgatttcatcgcctcaacgactttatctccaactcctaaagctgttccataaataagccaatccttccaaattgatatatcctccggagaatattttttaatcatcgctaagttggataaaaagtttttaaacgcatcccactccaatttttctttataataattggctttccaccttccaaacagagatgtaggggttaatgccaaaataatattttggacaacaaatactattgagaggtaaaatacctcattaaatgtttgggaatatttgggtatgaaatataggaatactgcaagtaatatagatattactaaaagtgctataattatcttctttcctcttgtttctaagaaagcatttaccacttttgatgaatatcttggatactccataattttatctaactcatcttttaacttcttaagtttatccttagaagatttatatttctgagcaagggattttatatactcagggtcaaatacattgttttttgaatacttcatcaaaaacttcataacatctgattcatatacatccaaattttctaaatctgtttttaaaatctctatttttccaccgttcattatttttatatagcccctgttatgtaagtccaataaagtggcataaaatccctctttatcaaaaaatccggcatctccagcaaatatgagattaacaatccatggttttctatttttatttggaacatagcttaaatattctggaactacataaaacttctcctttccaaattttaaatatatgatataagctatcaatggaaataacaaaattattgccattaggagatattttaaagtcattacaatgttacttacaaaagtatattttttataggcagatattgtttttccctctacattataaacatatcttgtgaatccattaactgaatttggttttaacaacatttcaacttcaattgggtcattctttggactacttccttcaatagtataaccaaaatatgttttataaaccttgaatgttgaaggatagacgaacaaatctaatatactgttattttcgtctataacattaattttaacatttttgtaagggaggtgttcatctgcaagctttaaatttatatgataaaatacattgtcggtctcaattggaggatatatgacaaacttataacttgttgtataaattccgggattgcgtatgtaaagagggttatagaatccaacttcgtttcttatataatatttatctacaatctcttcaatatttctttttatccagtcctcatcactaaatacaaaaatgtctcctttataatcaacaacatatccaaccatgtcttttgatgaggtagagaggtttaaaacttttacataaggggtatttaaactgccattatagaccaatggagctttccaatctctatatagcatcctgtacttcctaccttctaagacctcataactgtaaatttcttctaatgttaaattcttcccaatatacaaatttgcctcatagtctttaatatatatagaagtgtatttcattccgttaaatgatgtggtcaaaaaaattccaacaactcccacaataaaaatgagaagacagacaatgataatttccttctcctccctcataaaaatcccctaaaaattaaaattaataattaaaagctaatcttaggtctttcatatatctcctcttcaaactgcagataatccatcttcctaaatccaaataaatttgctacaatatttgaagggaatgtatctatttttgtgttgaactcttggactatattattataggtgtatctatgccttgcaatctcatcctctatctcctttattgcatccatcaactctttaactgtctcggaggtttttaactctggataattttcaacagctactaaaatatttcctaagatgttccttgactctctttcaatattttgaatttcttcagctgtgtttgctttcaatacgctactcctcagctcagttatttttgttaatgtttccttttcaaagcttgcatagcttttaactgcctcaacaagctggttaatcatgtccaatctcttttttaaagcaacccttatctgccccaatgttgcctcagctccattttttaatgtttggaatctgttatatattgagacaatataaatcacaatacctaaaacaatcaatgcaagtattaatccaacaataattaacaataacattaacataatttcaccacaaaaaagaatttgaattatttggatagtttagtatgtttgatatcaacttatataaattttattattagttattcaaatttgtaaccacaaactttacaaaagtttttcaaaatctcatttccatattctgtatgagcaacttcagggtggaactgaactccataaatcggctttgttttatgtttcattgcttcaacctgacatatatctgaatgagctaaaatctcaaaaccttctggaacttttttaacctcatccttatgtgaagcccatgcattgaactctcttggaacgtttttaaataaatcgttttctttatctacatagacctttgttagtgcgtattcttctgcctcagcccttccaacctctccaccataagccaaggcaattaattgatgtcctaaacaaatccccaaaatagggagtttagcatttaaagcaatatctatacaatttttagctttttcaatatcaggccctccacttagtataatacccttaacttctttattgctttcaatctcttccaatggtgttgtatttggaactatctttgagctaactccaatatactttaaacttctgtgtattctatgaacatactgccctccgttgtctaagataacaatcattttatcaccttatattttattagtatctttcaaaaacattttgaaagaaccttttagtaaaaggttcatcaaaaatctaacacctcctcgcttacgctcggaggtgcaactcagaaggatttgggtataccaataggcgaagccctatggtttctggaataactaaggcattaatgaacacctccctataggagagcgttcaaatatccattattaatattaattttaacaactttgaaagacactatattttaaaatttcttttattatgattatcctccaaatttattgaagtcagttttataatcatatttccttttatggatattatagagcggtagcttatggttatttaaattttaaatgatttcaccagtttacccaatattaaatatccaagattacaaatctatttagcattaatcattaaaaatttatttcccagtataaataacgtttatggaaaagattcaatagaagatgattgtcatggaagatgtatttaaaggcattgaaaaagaaattataaagatttacaaaatcccagagaggaaagggagattctccaacttcaaatttaaaaataaagagattaatgagctaattgatgccttaggatttaaattatatttacatcaagttaaggctttaaagtatctctacaataaaaaagatgtggttgttacaacatcaacagcaagtggaaagagtgagatttttagattggctatatttgacaacttcttgtcaaatcctgacgataggtatctgcttatttatccaacaagggcattgataaacaaccaatatgaaaaattctctatggagaatgagctattttataaaataactaacaagagagttaaagcagagatattaactggagatgtgggcttagagaaaagaagggagattttgaaggataagccaaatgtattatttacaactccagatatgcttcactatcaaatattaaaaaaccacaacaactatttatggcttttaaagaatttaaagctcttagttgttgatgaactccacgtttataggggagtctttggaacaaacatggtttatgtttttaagagattgttaaagcttttgaagagattaaataacaatttgcagatactctgcctctctgcaactttaaaaaacccaaaagagtttgttaaattgttgtttaatagagattttgaggttgttgataaaagctacaatccttcatcaaggaagtatttagcaatcttagagccaaagaatttggacaataaacagttgttgagaagattgatagagaatttagtagataacaatataaaaactcttgtattctttgatacaaggaaagagacagagaagttgatgagatttttattaaattctaaggttttttataaactctcaacctataaaggcactctgccaaagtatgtcagggaggagatagaggagaagtttaaaaatggggagatattagctttattaacaaccaatgctttagagcttggaattgatattggagatttagatgcagttataaactatggtattccaccagatggcatattttcattaattcagaggtttggtagggctgggaggagagataaagaagctttaaacatcatagttctaaggaaggacggtttagattattactataaagagcatctaaatgagctttatgagaggattaggaaaggaattattgaatacatgccagtaaatataaaaaatagatttgttactaagaagcacttgcattatttaatctctgagttaaaaatagtggattttgatgaacttaatgactttgagaaggagatagttaaagaacttgagagagaagggaagataaagatttataaaaacccaataaccaacaagacagagataaggaatgtaaaacagcctatttattcatcaataagaactgcaagtgatgagagctattatttaatcttagataaaccatggattaaatctaaattgttaaataaaacccaaagtgagattttgagttttataaattggcttaagattaagggctatgttattgaagaggttgataaagatgagtattaccgctctctaattactggaatgccctatttttcaagagggaagctgtttatagccaaggacaagataggtattaggaaatttcattttatatttgccgatgagttggatatgttttgggatgttgaagcactgcagaagaaagaggaagagattgacatcttagatatttatgataaaaagagctataaggatatagacatctattatggaagattgagagttaggaagatttatgagggatttattgttagaggagttgatgttgataaatactatcaagagcttttagctctaaaagataatggcatcttagatgcagagattgatttatttaaggatttctttggcttgaactttataagtgttaagtttaacaaaaagattattagagactttgagacagatggaatatggttatgttatttccagattatattagggatgttaaccaaatgaagagttctttgagtttcttggataagatagaagaggatgatttagctatctcaatctatagagatagaaaactcagcagaaaagagctatttccaatttacttgggagctacaactcacttacataaagaatgttattaaaaatagagttaaaaagcacttaaacgttaaaaaagacactaaaaaggttgaagagctaacctataagataaaaaagcttattgatagcaaagacggcattgctgggggtttgcatgctatagagcataatattataaagataactccaatctttacctatatagacagcagagagattggtggctacagctatgagagattcaacagaaatctgtttaaggataaagcagttatcttcatctatgacggaaatgagggaggctttggattggcggagattctatatgaaaatgctgaaaaactgctaaataaaagcttagagcatttgaaaaactgtaactgcgcagacggatgtcctctctgcatatactcaacaaagtgtggaacatttaacgaatttttagataaatggcaagcaataagaattttagagaagctactttcctaatatttttgaaataattttgaaataatattgactgcttcatctaatgtaactggtatttcatttatattataacccatattcttcaatttaataaaaagcttagatatctcaggaacatctaaatttaactcatccaaatttagtgaaaataaatcctttacttttccttcgaatataacctttttgtttaatacgtagcatctatctgccaagcaagccaaatttaaatcatgagtaactaaaaccacagtttttccacactctttaaatgattttattaaattcataatttcagccctactttttgggtctaatgcagatgtaggttcatccattaaaataacctctggttcaacagacaatatacacgatattgaaacctttttcttctctccaccacttagattataaggatgcctatcctttaaatgataaattttcatgtcttttaatgttttgtcggtaacttcaatagccttttcttttgagtaaaggtggagaggagaaaaagccacttcatcccaaacagttggattgaatagcatgacatcaggattttgaaaaacgaatccaacttttcttctgaattctttcatcagttctttgtctcttaatatttcgtcagttaattttttaccttcaaaataaacttctcctttatctggaaatactaatccatctaaaatttttaataatgtggtttttcctgctccatttggtcctaaaatagctactacctcatttttgtatatatttagatttacattatccaaagcaatagaaccattaggatatttatatgaaacatcaacaagtctatatatttctttcatagtatccctctatcaaataatacaagtaaagctgttatgattattgaaaataataaaaatgcgatatctttaattttaatttcttctctgtagatgtgctttatttctccattatatcctcttgaaagcattgcataatatgkgtcttcccccatttgataagtttttataaataatgctccaatggcttttcctgcctctttccaactctccaccattcccaatttattaacgactcttgattttcttgaatacatcatgtccaatacaaaatttaaaagtaaaaatatatacctataggcaaggtttgttatagtgataacaacctcaggaactcctaatttatgtatggcagaggtaactttattccattgtgttgttatagggatgaggactgcaaatgatacacatgttgctactctcaaagtaaatgttatagcatatataagcccctcataagttatagagatgtgggggttatttaaaataacaaaaacatcttttccaggagtcataaagttaaacattactggaatggcaattattccagcaaaaattggaataaatacataaactctttttaaatattgtaataggggtatattagataaatatgcaagaattaatgcaattgagttaaatatgattaaagttaaaatatgcttggatagaacacttccaacaagaaatataactaaggatattatctttatcctactttctatattctgtaaaagccctgatattcttgtgtatttttcaaaaaatatgttctcatttaaatactttattacatgctctattgttttatcaaataacttattgttcatattttcacgaataattctgctttttatattatatattttaaacaatcaaaataattacattacaatttttataattattcaataaaaattatcaaaatctttaaaattattatattaaaatcactccaaaaataatagaagatgaatatagaaattaaaaaagtaaaaaaattatcctgccgctgcttttggatttacaatctttataagtgcgtagtatgccccaacgcatagtattactccaactattgcagatattatgtatcctatagatgcatgaaatgggtcatcccatcctggaatatcatagtctggaagaggagcatagctccaaatatccgctaaatgtagtaatccgctaactttatcttccccaactttttcagcaacatcttctggtccccattctccccacgcatctccataattccaaactaacaatattccaagaggacagagaattaccatagctacaattaaatagagaaactttttaactaaggggtcttgccaattcatgcattcaccccactaacttgctgttcttttgatgtgaataaatcaggtcttactttctttacataccaaacaactattgcagttactaccgctgctgcaggtcctgctgttatcaagtgagcaaatgccattgctggaactgagacggtgaaagggtatggacaataacctggctctataaatggctgtaatccaaactcaaagcctgcaacaattgctgctgcaacaattccaacataagccccaataccacttgcaattacttctccaaccttatctcttaagaatttataaacataataaccaacaaacggtaacacaacacccatattgaagcagtttgctccaatacaagttattcccccatctccaaagaatattgcctgtataattaaaacaatagatattgctatcgtcgcaacccatggattatccatcaatattgctatcaatgtccctccaaccatgtgagctgttgttccatctggaactggaaggttgaacatcataactaagaaagagaaagctgttaaaactcccaacaatggcaactttcttgggtctaactttttaagctctttaatactcttataccaaattggtatcattatcaaatagaagaaagcacatgttattgggccaaggtagccatctggtatgtgcatagtttcacccttttggtattatttaattgtgttatcatcatatctaatgttgataatactatttaaacttttttgtttaaagtttattaaaaatgtcttgagctaatataaaaaaatgttacataaaattaaaattgacaaaattgagatactaaatattattttaatggaatttttaatatagtatttgaaaaatataagattcagtgatatcatgcactggattgaaaaatatctgaaaatattacaatgtccatactgtagaggagatttatacttaaacaaaaataaaaataagttgatatgtaaaaaatgtaatagggtttatgatatagttgaaggtatccctatactgctaagatactgagggataggatgaggctgtttttggctatagacatcccagaaaatataaaggaagagatagccaaatttcaagaacagtttaaaatgaaagggataaagttagttgagaaagagaacttacatataaccgttaaattcttaggagaagttgatgaagaaaaattaaaagaaatattgaatttagatttatcaattcagccaataaaaataaagctaaaatatattggaacattcccaaactctaactatataagggttatatggattggagcttacaataataatcttgtagaaatctttaaagaaattgatgaaaaactatcaaacttaggatttaaaaaagaaagagagtatgttcctcacttaacaattggtagagttaaattcattgataacaagaaaaaattaaaagatagaattgaaaaatataaagatgtagattttggagagtttgaagcaaaacacataaagctttataaatcaactttaactccaaacggtcctatatatgaggttataaaagagtggtagcaatgaatgagaatcagcagaagttacattatataataaacctattgacaaatggaaataaaaagagatgggttaaacagacagttttatttgctcttatatattattttataaaattagatgtctttaaaggttatgactatgccccaactccgtttatgtgggaagatgaaataaaattcataaatatctcttatgaagcaataaatgatttaaattatctcttggataacaattatttaaatgagattttactatcagtcagagggttaaatgagtttattgttggatatagtattggaaaaaagatagattacaacttcaaccagaaagataaagagacaattgataaaacattattggaaaatgggagactaaaagaaatccaaataacaaagaatggaataataataaaatctaaaaatgaaaaattagaaatagagattacaaagattgataaaattagctataaatcaaaaagctacataatgaaggtatcattatgggattcaaatatttaaaaataaaaaatccaaaggtaatcttaactgaatggattccttttggaaagaattatatgactgagtttatagataggattacattaaaagagtatcaaagaaaaagaattaaatactttaccgcatcagaaaggagagatataaggtataaagcagtttttgaaacatctgaatatcaaacaacagtaaatattattgaatttattccagaaacatctgtaaaatttacagctgaaattataggggaaaggaaaaaagacgtttttatatatgttgattatcttggaagatgtatctactcctctgaaataacaaaagctggagatgaagaggagattgtaagcttagataatctttctttcgtgattcctgacttaatcttggactcttcaagaattatgagccatttaatatctccaccacaaagatatttacttgaaactctctatggagagataaaggtatataagcacgttactgttttaacagaaacagttgttaatatagatgaaaatacaatattggagattagtcaagttattggagcagttaagaatataattgagatagatgatgggttaataatctttggagactttggaatatttatctcacataaaaatccagagaagtttgaaaaatttatctactactatccttttataaggagtattactggcgtttcaagggatttgttttttaaattaaataatattgcctctaaattggaagttataagtaacacacttgcatcaggagttgatttagaggatataactgaaattaggggagagttaagtagaatagacagagagttggcagtaatagaaattgtctgcggttatctaaaagaaatagttgagtttttaaactcctcttatcctccaaactttggggactttgatttaatgattttagagaaagttgaggcagaaagaaaactaagaagattaatttataggattgcagagatagaaaacattttaaaaagtaatgatagcttagcaacaagtttaacaaggttattaactacaatatccgaagatttagagagaaagatagctaatcaattggctgaaaataccaaataccaagtagctattggagaggcgatggaagttttagaaattgggatttttggtgtctatgccttagaagcagctcatattttgttattaacttctggaaaagacgaaatacttcatcacattaaaatacttggatttccattggagttctggataatattagtcgttacaatccttggagtttatgttgggaaaattgtcattgagtatagaaaaaagaaagttttaggagaataaatcatcatctccaaaggcattttcttcaatatcatctgtttttaaacgttcagtatttataaagtccttttcccataattcaacaagatttaaatcctctcctccatatcttccgtcaaatttatctaccttaacaattgctggcacttttatacacggtcctaaaattatcgcctcaccaatgtttaagcttgttaattgtttaactaaatcttcactcaaattttcagaagccatttggacatgtttttggtctgttggttcaataagcttagatattattagattagagcattgagataaagtttcagcatctaatgttttaggtctctgtgaaactaagcataaaccaacaccaaactttcttccctctcttgctatcctgcttagataatgcttagcccttgtttttctatgttgtggagctattaaatgtgcctcttcaaaaatcataaatattggttttgcaaagtctcttcccttatcaataataatcctcttcctatcatccaaaactgctttagctatataagaaacaacaatatccacagcattctcatccaattcttccattggaattatgttgatataatgttccctaatatcatttattggattatagtgaagagttataatattctttctaaactgcaacatatcttccaatctaaatatggctgtttgaatactactttcatcttttttataattatcatttgatttgtattcttccaatttcccaattattgcatttatataatcatcaactgtgctgaaatcatgttctttacgttcttctttaatttcttttatcgcctttcttatatatggtctttgctttgttgcttgggcatctacgccagccaaatcacacaaatcatcatcatttatcctatagatatttattttcggctcaattatatgaactcttagcttttcactttcgcagtaaatatctttatattctccatgcatatcaaaaactaaaacggttgctttaagcttattcaactctcttaacaaaacagctacagtatttgactttcccatcccagtcattgccaatatagccaaatgtcttgaacataatttatttgcgtctaatttaacctccacatcttcccttgtaactaaatgccctatttttaaatgcccattaccaaaaactttttttaataactcatcatctgctctgtaaattggtattcctggctttggtggaactctcggcaactttaaagctccatctttatttaaatctctaatatctcctaatacctttatctttcctaaaatgtagtaggatgagttatcttcaaactccctaattttctctaaatgctcaatgtttaaaatatcctctaaagccatgtttccttggattgtgctttcaaccattcccaataattcagagtcgtcataatttattttaacataatccccaacttttggggcttctttagccaaaaatgttaattcatcaatccttgtttctcctattgtgtagccaataatctcattattgtccatctaatcaccggatgaattatcaattacctttatttttaaattattttcttctttatgtccttctttaatctcttcactatcttctttttcttcttcctcttctaattcatcttcgttaattataactcctcctttagttcttggggcgatgtctttaattatcttcataatatcctcattttcatcagccaagattttaacaaatatcccaccatgtgtgtctatatcaaaattcacggcccctacataagctgcctgtttatttaaataaaattttgttgcgttctctgtcattcctttctctaaaaccatccttgcagcatctaatattgactgactccttaaaagttcctttaacttctctacactcttagtttttccttcccattctccaaactcattatctttctcaataaatgttaattttgcctttggaaatatgtttaagatagcttttttaactttatatttatcttcagttggcttcaccttagctttaataatcacttccataatatcaccatttaaaattttttgttatagtttatataaggtataaaaggattataaaacttcttgagagtatgtttttatgattacacatgaaattcattatgttctataaaaacattctgatattaagtattttcctttatttattttcaagttttcatttttagctattttagttataaatttaaatatttattctaattaattttagtaaattttatataccttcccattaattacattttattcagttagttcaaaaaattttgaacaatatgaacgggtgagactatggcagattgctatattacaaaaataaaactaaaaaataaataaaagatggcacgctaaaattctatctaaaaacagttaaaaagattacaaagtgataataatggaagaagcaaaaaaattaattattgagttgttttcagaacttgcaaagattcatgggttgaataaatcagtaggggcagtgtatgccatcctttacttatctgataagccattaacaatctcagacattatggaagagttaaagattagtaaaggaaacgttagcatgtctctaaaaaagcttgaagagttaggatttgtaaggaaagtatggattaaaggagagagaaaaaactattatgaagctgttgatggcttttcatcaattaaagatattgctaagagaaaacatgatttaattgcaaaaacttatgaagatttaaaaaaattagaagaaaaatgcaatgaagaagagaaagagttcataaaacaaaaaattaaaggaattgagagaatgaaaaaaatttcagagaagattttggaagctctcaatgacttagataattaatttccttataatggtggtattgatgcttagagaaatattaaaaaaagttgctcatttctccgaacaaaaaccattcctaatgcttctaattatcttaattataactgtatttgctggaatatcagcaaccaatgttaaatctcaaactgcctttgaaaagatgcttcctcaagacaatccaattataaaaaccctatatgaagtcagggatgaatttggaggaactgatgtcataactatctgtataaagctaaaaccctcagatagcagtgataaagttgttgatataagagacccgagagttttaaaagcaattaaagaattggaggataatttaagatatgtagatgggataacaagcgtaagctctccagtagatataatcattcaaaaaaataacggtattgtgccaaatgacattgatacggttaaagatatcctaaataaactcccagaagataagagaaagagaatattcaactcagactattcaatgacagttgttaatgcatatactgacgctggtggagaccagaaaaagctaatgagagtaatggatgatgtaaatgaaagaattgaagaaactccatttcctccaggagttgaagttatagcaacagggactccaccaatgaggaagttgatggatgagttaatgaaagagagccaaagctttacaacaacagtaggtctaattgggattttaataatattgattatctacttcagaaagccgttatcctctataatgcctctcttaccagtgcttatagcagttatatggactggaggagctatggggcttttagacattcccttggatatggcaaccgctggaataggctctctgatactggggttgggtattgattacggaatacatttgatgcataggtatgatgaagaaagaaggaaagggatgccaatagataaggcaatagaaacagctgtagttgaaacaggaactgcagttatggctacaacagcaacaacagtagttggtttcttagctttggttttagctccattaccaatgatggcaaacttaggaaaggtctgtgctttagggatttccttctgtatggtggtggttttaaccttactaccagctttaattgttattgaagagaggcatataatgccacttattaagagattgaaaggtgatactcaatgataaccaataaaataaaaatattcctaatatcattaatctttatttcaggagtttatgctttgcaggtagatgctcctcagtatcagccgaatgttattcatcctggggatgatgttgatttgtggattaaaataactaatgataattatgataatgaagttaaaaacatagttgttgaggtttctccacactatccatttgagttaaggcaggttaatccaattaaggggaaagcaacaatcagccatttaaatcctggagaatcagacactgtatatttcaaactacatgttgatgaaaatgccccatcaagagactatgaaatagatgtaaaggtaagttatgatgaaattaataaagaagatgggaaagaaacaatccaccactatgaaataactaaaatctattacctacatgtttatggaatagcaagctttgaaattaatgggaattttagcctaattccatcaaaaactcaaacagttccaattgaaattataaacacaggaacaggaacagctaaggaagttaatctgtatattggatattctttaaactctgtaaatgctggttctgagtcagttgaagtatctgcctatgggacaaccaaaacccaagaaaaaactatttactacccaacagctgttcctatatctaatctaccaatttcaccagttggagaaacaaaattctacttaggagctttaaagccagataatagcagagtaattaatttaaagttatacactgcaagcaatttagttgagggctgttatcaaatccctgcagtaattacatggatagatgaagacggaactaaaagggcagagcagataaccattggagcttatgtaaaaggagatattttattgggaatatctaatgtggtaactgaccctaaggagataaagccaggaacaacttatgtgagaattgatgtaacaataaccaacaatggacatgcagaggcgaaggatgttaaattaaaattaataacaaataaaccatttaaagatagctggagtaactgcaatataaaagatgttggcaacttattgcccggagtttcaaagacagtatctttctatgtggatgtagataaatatgcctctgctaagcattataagcttccaattgaaattagttatttagatactgccaataacaaatacaaaactgaaaaattcatagacatctatgttaaaccaaagccattatttgagattataacaaaagaagttaatgtaactgctggaaaagaaaacaccgtctatataacaataaagaacgttggtagtgaaaaggcagagagagttaagatttcagcaattagaaactctggacaaccatttgattacccaattaaaagtgacactattggaactctctaccctaaccaaacaggaactggagttatagttatagatgttgataaaaatgctgaatcaaagccttatataataactattgaaataagatgtgcaggagatagtgatgagggagataataacgtgtatgtctatcaagaaccgttaaaagtggtagtgaataattcaaattcaaaaagttattggatattgggaataatagtggttattgccattgtattggttgtaggatatgtatttaaaagaaaaaatagcaaagataaagaataaaacactctatttatttttgttttttgaatttttcctatttcatttttttattttaacgtttttaggtggttttatgggaaaattagagaaaaatgtttttgttatttggattactacctttacaactatgcttggtgttggttttatagcaccaattatggcaatatacgcccaaacactgggagctacaaatttagaaattggtttaatatttggttcatttgcattagcgagaacagtagctcaaattcctgttggagttttatctgatatatatggaaagaagttttttattgtctgtggaacatttttttatggagtctctaccttaatgtataattttgttagcacagttttaggttttttaattgtgagaatttttactggaatcttttcagcttttgtaacaccagtagctgggtcttatatcgcggctatagccccaaaaacaagattaggagaatatatgggaatttttaattcagcaattacattgggctttggcataggaccttttatagggggaattcttgctgatatgtatggaattaaaatgccattctacttttgtggatttttaggaattttggcggcaattataagctatatgaaattggaggatattgtttttaataaaaataaagaaaaaatagatgttaaaaaaatatctactttattctcatttgaatttttgaaaaataggaatttttcatcctcttttattatcaatgtatctaatgttatgataaatgctgggatatatgcgtatttggcattgtatgcaattaactacaatataactataagtcaagtaggttttatgattgctttaacaaatatcttaatggctttacttcaaagaagttttggaaaactctacgataaattgggaaatataatgataatcattggaatttttataatatcctttggaatgtatttgctctcaacctctacaacttttttgactatattggcttctttaacaattatagcagttggtagttcaatatcttccaccgccacaacatctctcgcagttaaagacatcccaacacataagaaaaggcgaagctatggggctttttacaacaagcataaatattgggatgtttattggtgcagtgtcgtttggattcttagctgatattttaggaatagcaaatatgtataaattttcagcaatattttcaattgttgtagggattatcagctatttaagaatagaaagataaagataattattttaatcctgccaatattttatttaatatttcttcaaacaatttctccctattttcaatagttaaagtatatagctctcctttatctttaaatttatttacccaatttctgtgtagtgtggctaataacggtttatcacttttaataacctcatcaacaacttcagaaaactttctactcttaaattccatagctccaagttcatctataattataatatcagcatctttcaaagccctttttattgcctcaactccaacgttatctaaattttctataaaaacagcatatttaccaacttttatttttccatctccaacataggctaatattgtttcttcattggtatctaaggttattattttaaatcccactctttttcctccatctctaatctccttagttataaaacctccaactttatagcctaactccttcaacttctcagctatctttaaagctaatgtagtttttccaactccgggcattcccgttataaatatcctcatagtttcaccacaacccttaaattgatgtatgtaatgtttaaagttataaatcataactcactaatcaaatttaaagaggagagaagatgagtagagttgtagtttcagttattgggcaggatagaacaggaatagttgcgggaatctcaaaagtattggctgagaataatgcaaacatcttagatataagccaaactattatggataatctatttgccatgattatgctcgttgatatatcaaacgctaaagtagattttgcaacactaaaaaaagaacttgaaaaagctggagaagaattgggtgttcaagtcattgtccagcatgnagatatatttaaatacatgcatagaatttaatcaaatcctttcaaatttagcatctacaacaacatgccaaacgcctggagcgtattttttaatctttctcacttcataatctatcaatttatagccatttttttcagcatagaattttaatctctctattggtctttcatacataatcttttcagctactgtttcatgataatgtataactcccctatcttttaaaaattcaaaagtcttatctaaaaatttgtgtgttttatgtacatagcccatgataactctatctgcgacatcttttaactcaacgtctctattatctgctaaaattgggatgacattatttagtttatttaatttgatgttttcacatagataatgataagctgtaggatttttttcgattgcatagaccaactttggttttgagtatttagctaatggaattgtgaaataaccaataccagcaaacatatcaacaactacctcattctcattgcttataaatgccattcttttcctttcctcaatatttccctgactccacataatcttagcaacatctaacttaaacaaacagccatattctttatggattgtttctgtttctttcccatataggatttttacatgtggagttctaaattcaccggttatttgggttgtgtatagcaagatagctttacatttagttctttttacaatctctctaatttcatcctcacttaattcttttttaacgataacaacatctccaatcttttgatattttatacccataatctcacaatattaaagttattatcacaaacaacgcagtnatcaaaattctaactaatgtagatatcatcatcaaattaaaaccatctttaaatccatatatgcctatataatatggagctaaaaatctcaacgctggaatgcttgataatatagagccaagaagtaaagctcttacaacttcaatctcatctaaaattcccctatttaaaaactctccagctaagacaaaagctcctatgtagtttattggttgggtaactgccacagtaatttcttcaactgaaagtggtagataataagctttattttttataatctcagttatatagtcaaaaaatccaaattcaatcaaaaatgaggttataatggaggctattgttatatcccttattattggaattccatactttatagtgtttttaaaagctgtataaacaacatctttatttagttttatctttttgtctgtgttatcttctttatactccctattttttaatgttatctttccaatagccataaaaatgagtgtttgaataaatccaatcaaaactaagattataaaatagattattccaaagaatcctaaggtggcaagcaaaattggcaataaagaatcccagtgcctaagcattgccggaaatgcatctattaaagatgagatatagagttcttttttgtttataatcccttttttataaaaatctacaagcattatgtttgccattcttggttcaataaaagatgttgttatagctatcccacactcctctggaagatttgccaatcttgtaaatatctttccaataaaatagatttttttgatgatattactctctatgagaatttgagagataaataaaccaacaataagcattggaatgctgtaatacaaaaaagtaaatgtcaatgtaagtgtttgaattatcttatccatcataataatcttattaatttctcattaaaaagtatttaaaaattatggagttaatctctgcctatctcttgggaataaaacacactctctaatgttctcttgctgagttaataccatggtaaatctatccgctcctaatccccatcctgcatgtggaggcattccatacttaaatgcctctaagtaatatgtaaatccatcagggtttaagcccttctttttaatattctcaactaataaatcatataagtgaatcctttgagctcctgaagaaatctctaaatctttatacattaaatcaaatgccttacaaatatttggatttttctcatctggcattgtatagaacggcctaatttcagaaggccagtcagttataaagtagagtccttccatctcctctccaatagccttctctgcctctctactcaaatcttctccccagctaatttcaacaccttttgcatttgcaatgtcaatagcttcatcgtaagtgattctatcaaacttctctggtggcaactcaaactctattcctaaagtttcaatctccttctttctattctcataaacatctacaaatgcgttataaacaactttctccaatatatccatagcatccttatcatcagcaaatgccatttcaatgtctattgatgtagcttcatttaaatgtctccttgtattatgctcctcagccctaaatattggagctatttcaaaaactctatccaacccagttgccattaacatctgcttatacaactgaggactctgccctaaaaatgcctctctctcaaagtatgagattgggaagagttcagttcctccctcagtgcaacttgctaccaattttggtgtatttacctcaataaagccctcattatagagtgtgtttcttacagattttagcatttcacttctaattttaaatattgcctgaacttttggtcttcttaaatctaagaatctattttctaatcttgtatctaactctgctgggactttttcagctgggtctaaaggaagaggtcttttagcggtgtttataacctccaactctaatggtaatatttcaaaaccatttggtgctttttcatttgctataacttttcctttaactgctataacatcctctgctccaagtttttttatttggctaaacaactcatctccaactttttgttttggtgctacaatttgcactgtcccttctctatctcttaaaataacaaatataattttccctaaagctctaattgaatgaacccatcccattataataacttcttgtccatccatttctggtttaatatctgctgagtagtgtgttcttctccacttcattttattcaccatctacatcatgtgtttcccaaatcactaaaaactttttaaggttaataattgtgtaaatggtttttatagtttcctaagcttttgtgtatctatatatttaattttataggttaaaattgtcaaaaataaaaaataattaaaaaattaaatttatttaaacccatagccataaggcagatagttttcaaactcaatttttttaactaattgccagttattttcatctaaaatgtgcatctctgaaagtgagaacgtgtatagataattgtttataaataaagccctcaaaacatttgttttatgctcatcgtccttaaccatttctatcttattgtcctcaactttaaacacataagcatgattataagcaggtagaaagaagattttatacttttcatcccataagaatgcgtgatagtccctaaacgctggactccaccaaacatttaatttatatttatcaacttctttcggattattcaaatcagaaatattaaatagtgagatttttaattttccatcgtcatctttaccaataccaataaataaattattacctattggatgtaagtaagtggaatatcctggaatctttaactctcctaagacctttggattttttggattttttaaatcaataaccaataacgggtctgtctctttgtaagttactatataggctttatctcccatgaatcttactgcataaattctctctcctttttctaatccagttagcttaccaacaacatttaaatcactatctaagatgtagatgttattggtcattttatctctgaatctccagtcccctattgttgttgccactcttaaatagccgttgtattcatccatagcaaagttgtttaagagatgaccactaacctttccacttttaacttcaaagctgtctaagttaattttagctattccagtgtattcaaactcttcccagtgttcttctaaatagttctcaaagtcattctgcaactttttcattaggttgtgtctcttctcagaaggaagggagcttaaatatctttcaatagtttcagttatctcaacgaacttggcattgtctccaaagtcttcattttcaataactctctttattttatctgccacttctgttgggaagtatttatctgcactttcatttaaaaagttaagcattaatttcttctcattaatttttagattataggcaaagtataagttgttctttgacatgtatagggttgttttataatttccaacaattgcaattgagttttcaacttttccactttttatatttattctgctaataatatatgttgtatcaaagtccatactgtatattgggggaagttctggaatgtagtatttatcatagccaattttataattgttccatacaattgggcaatctatagagttttttctaactactaaatataacgttccattatacaaccttgaatcaacataacttccatttaaatccatttgccaaattatttttggcatttctggatttgagacattataggaggttattttattccaacttataactattagtgtattgtttgttaagtaaagataaccacattcagatatgttttttattattttagcatattttggaggaaggggcttaattaaataaatcttattttgagagaaggcaataatgttcccatttgtttttaatatatctgcttcatcaactcctttaacttgaacattggtttttgaaaatctttctggctcagttgaggtttctacattagaagatttaacagttgaggttatctgcacttctctacttgcataactatgtccaacgtagatgtagtttcctattgaattttcaacggtatttttaaattcttcaaaatttgatttggaattaacaggaattaatttgaaatcattacttccttcttttataggcttttcattttcaacgcatccagaaaataatgatataatcattaataatgataaaaatattgcaactgccttaattttcattatatcacctaagaatatttaaaaagctaattcatttatatatctaaaaaagatactatataatgatttctaaatcgttcggttatctccgaataattttataaactaaataaactataaagattattaaaaaagtagagataattaaaaaaattaaaaatagcggctctttctgaaaagttgttgaacctttgtaagttgtataaatacccctttcaacaactgtttttgataaaacaacttctcttgcttggtattttatttgtttgaatatatagtagatccacaaaccaattagtgcaaaaatactgctgaccattaaaatcaatgcttctaagttctctaaaaccttctttcctttgtttgttattttataataaacccacttgctatagttttctttatcaaccaaacccatttcatataaagcgtttaaatgctcacttatcgttgattttgattttcctaaaatttttgataattcagagatagtataattcctttcattcaatttttttaaaatttcaatctttgtctttgaaaatagaaatttcataatcccacaaaataaaataaattaattctcaattggcttaaatttataaccataagttataactccatcatctccatcttctttaattcttctaaatactgcctcaacttgcatgcctatataaacatcttctggcttgcaatctacaatttgtcctgtaattctcgctccttcctctaactcaatgattgctatcacataaggagcttgtttttcaaaatcctttggagctacatggacaactgagtatgtataaacctttccttttccacttaattttatctcttcaaactctgtttttcttctacactttggacatatctctcttgaagggaaataaacagttccgcaatttttacatctaactccaattagacagtatctttctttaatatgtctccaacttctgacaaccattttatccctcaataaatattttattcccatcaaccttttctaaaaaggttgatcaaaatggatgcatcacctcgctacgctcggtgatgcctcttagcttagctactattaatataggaaggcatttccgaatttatccctctataaatatcttattctcattcaaatcaatctttttaatctctccaacaaattcttttttatcaccaaataaatcaatggctataactttatctccttttttctcaacaatcataacatcttccataaccaactctccattaaagtagagattgcaactacacatattttcaccatttaactcgcttcatcctcatctacatcttcaacttccaaggttccattttcatacccataaagctcataaatttttgatgatatgtagaggtcaatgagcataattagcctacactctcccccaacccacattacacacttatcttttttgcaaatatctttaataaatgggcagaacttatccatttagctcatccttcctatttttattaaatggtaggtagataagggatatttagtttagttttgtcatatattataaaccctattacaaacaaacaagcaaatattattgcagaaatcaacaaaaatacagttaatccatcaaatagataataccaaataataaaatccaataccacaaatccaatgcttccaattactatagtaagcacttcctttttaattttatccataaatatcctctaattatctcttatcagacaatatatggatgcatacagtccctccagtccctccgacatttacagtaattccatagccatttttaatctctacctgcctatctttaacctccttatcctgctttaactgccagtaaatctctccaacctgccttataccggtagcccctaatgcatgtccagcagctttcagccctccacttggatttactgctgggaagccatcataatcaatagctatctttttatcataaactatctttccagcctctccctttttacagaaaccaagttcctccatcaatattaaaccatttatagcaaagcagtcatgaacttcagcgacatccacatcctttggttctatatttgccattttatatgctttttcacttgcaactttagcagcttttaagcttgttatgctctctctgctgtgtaatgcaattgtatctgatgcttgaacacttgctttgatgtagatgatatcatctttatttacaaattctttagccttttctgcttcacatactataagggcagcagcaccatctgaaactggtgagcaatgtagtaatcttaaaggctcagcaactggtgaggagttgagaacctgctccaatgtaaccttaaatgggaattgtgcatatctattttttgaggcgttttcatgcatgataacgctccacattgataactcctctaaagttaagccatactcatacatatacctctgagccatcatagcatacagtgaaggaaaagtagctccaaacaaagcctcccattcttggtctgaagctgatgatattgcagaggttgcatcaacaacatcagtcatcttttctactccaccaactaaaacaacatcacttgccccgctcgctacatttaaaacagcttgtcttaaagctaagctaccagatgcacaagcagcttcaacccttgttgaaggaattgggtttaaaccagcatgctcagctattaaagaggctatatgctcctgtccaacaaacaaaccagcactcatgtttccaacatacatctcatctatatccttcccatctatacctgcagcttcaactgccttaacaccagcctcaacaatcaagcttctaaaacttctttcccatagctcgccaaactttgtctgtccatagccgataatggcaacatctctcattcttccaccttttcatagaattcaatgagtttaattattatcagatgaaatgcttcgcatttcattactcgcatactttcgtatgcgatttcatagagttcatcaattctttttaaaccttcttttacaacttctaagtttaatttatcgtatttatggacaatagcgtttctaagcctgttatattgttttagtagagtagcttcatcttttgtaataacatcatgcttcaaaagtttcttaatgtttgtataatcatcttcaacattcaacccaatgtctttaacgagcattgctacaacgtccatagtaatatcaacacatacttgaagagaaatataataaagccctttttgtaatctcatcccttatttcatgttcttttatgaagtaatattcttccccaaacttttcaagcttatccaagtatctcttctttctttgcattaaatctcctcctcaacataaccttttctctaacactgttgaactgattttctctaatcctcttttccatatccctccaaatctttctaaatttgtagaaatgctctgaaagttctaattcatctccaaaaattactttatgattttttataatctccatttttatatacaaaggaagttcttcaaagatttttatgtcatatttatttcccaattttcctaagatttctaagtatgtatttctatcaacccctactaagcatatatcaatatcactcctttttgtgtattcattctttgcataagaaccatatagcagaattccaaaaactttgctcacatcttaattttctttctaaatttggcatatattgcatagtcgatatattctttcctctctaagtaataggctgtttttggagctttgtctttgactttatttattctatcagttactgttatgtcgaaggcatcacttccagccccacttccataggagactgctaaaattctctctccaccttcacaattatctaagacatttgataaccctaaaggaacagctcctgagtaagtgtttccaatataaggggttaatagccctattttatattgctcttccttaaagcccaaaatcttagctaccctaatatagaattttccgtttggttggtggaatacgcagtaatcataatcttctggctttgttcccattttttccatcaatcctttagcagcattaattacatgtctaaagtatgctggctctcctgtaaatcttcctccatgtcttggatatggctttccttctctcctccagaagtctggggtgtctgttgtgtatgaataagtgccgttgaattcagctataacgtttgattttcctattatataggcagctcctccagctgctgccgtgtattccaaagcatctcctggagctccttgggcagtatctgccccaatagctaatccgtatttgattaagccgctctcaaccaatcccatacacatctgaattcctgctgttccagctttgcaagcaaactctaaatccgctgcagttaagtctggagttgcatctatagcctcagcaactattgtagcagttggtttaactgcataagggtggctttcactcccaacataaacagctccaatgtcttttgggtctatttcagctctttttaatgcatttcttgctgcttcaactgcaatagttgcagtgtcttcatccaagcttggaactgctttctcatataccaaaagtcctttttttattgattccgggtctttgttccatactcttgctatttcttcaacttttatcctatattttgggatgtatgctccataaccaacaatacccgccataatttcccccttattttatctcatttagtctttttataagttctttagtatctaaatgggttgttattagtgggatgttatcaatctcagctaattttaaagctaagctgtctatcttgtctttatttattccctgcaaaacaacaactcttggcttcattatgctgactctaacagcaaccattgggcttcttccagtagagacgtttgtgaatattaaagctctttcagtagtccatccgtataaatgatagaaatcatctcctgtcatctctaatattgcctttatactatcaacaactgtatgcccatatattggagtgtctgagttatctccaacggcaatttctccatcaataatatttacaaattcattaagggttattgggttttcatactcttttattgataaaattgccttcattgaagggcttttatctaaaattctttttaatgcttttattgtttgtcctcccttctccttatctatttctattaatgccaaaacatacttttttataatattcactcctgggttttttcttcttccaacttcataatcacttataacggatggagaaacgtttaagtatttagctaactcaatctgctggatgttgaataaattcctccatttttttagagcttttccagtattttcagctaaaacaatatctcctataatgtatattgctactttctccatattaatcacaaaataaaaataaaatgtcaatattatataaagtttttgattttgttgaaatgcattatgtttattgtcggatattgtaaagagaagatttaaatactttgtctaatatattagacataaaaatattaagagtgtcaagtatgatagacaaaaagatactatttgaagaagttatattagacaacttagagattgcaaagaaagcaaaggtaattaatagagatattgaaataaaactcatccctaacaaaataaaggttatctatggtgtgaggagaggaggaaagacatatttcttatttcaaattataaacaagcattttaaggatgatttcatctatataaattttgaggatgaaagattaataaatatagctttagatgagttaaatgaactcttaaagattgcattgtctataaaaaacacaaaaaacctattttttgatgagattcagagtgttgataattgggataaatttgttagaaggctaaatgatagtggtttcaacatttttataactggttcatcttctaaattattatcaaaagaaattgccacttctttgagaggaagaaatttaaaaactgaaatattaccattaaactttaaggaatttttgaaatttaagaattttaatgttaagaagaggtattccacaattgaaaaggcagagttgctgaagtatctaaacgaattcattaaatttggtggttttccagaaataactttaatagatgatgaaaacattaaaaaagaaattcttaaagaatatttggacggcatattttatagggatgttgttgagaggcatagcattagaaatataaaggaaattaaagttttaaggaacattttaataaatttatttgctaatgagatttctattaaaaagattgccaatttactcaaagaatttaatacaaaaataagtagagagtgcatttacaactatttagagtattttagtgatgcctatctaatatttttattaaataatttctcttataagactaagacaatatcctactcaaaactctatgttattgacggaatgtggaacttctccttaagttttagcaaaaataaaggaagaattttggaaaaccttgtatttttggagttgagaaggagaggttttgttgagaatgagaatctgttttatgtcaaaaggaaaaactatgaggttgattttttaatatttggagaaaataaggagttaattcaagtatgctatgaattaaatgagaccaataaagaaagagaaatcaaagcttatgaaaaggcaataaaagatttaaaacttgataatgtcaatttaaaaattatcacttacaacgatgaaggattcgaaaaaataacagttgatgataaagaacatctgatagagattgttccattctggaagtggagtttaacctattgatattttaataatgtaaaagacatttttaaattaataaaataaaaaagagattaaaaattattccttctccaagccacacatctttcttaactcttttccaaccttctcaattaaatgctctttctctaatcttcttaaagcattcaagtgtgggaagccagcttctctttctaagctccattcttttgcaaatcttccatcttgtatctcttttaaaatctctttcattgcctttcttgactcctcatttataactcttgcccttcttgttaaacctccatattcagcagtgtttgagacgttctcccacattccctgtaatcccttttgatagattaaatcaactattagctttaactcatggcatgtttcaaagtatgccatctctggagcgtaaccagcttcaactaatgtttcaaacgcagctttaattaactcggtaactcctccacacaaaactacttgctctccaaataaatctgtttctgtttcttctctaaaagttgtttgtattactccaacttttgttaatccaatacctttagccattcccaaagcaatttgtaaagcatctcctgtataatctctctcaacagcaaccaatcctggaactccaaatccttcttcatatgtttttctaaccattgcccctggtgattttggagctaccattgttatattaacattctctggaggtcttataaatccatagtggatgttgtatccatgtgagaagcttattgtttttccttctgttaagtaaggctcaatctgctttttataaactgctggctggacttcatctgggattaatatgtggatgatatctgctttctctgctgcttcctcaattgtcataactttgtgtccatctttaattgccttgttccatgatgctccatttggtctcaaaccaactataacatttaaaccactatccttcatatttaaagcttgagctcttccttgacttccataaccaataactgctattgttttgtctttaactgcgtcaaaggttacatccttatcgtagaatattttaaccatttctatcaccataaagactctttttattaaatactcgctacctttattagccataatactattttaaggttttcggtttaatttgatattcagaaatcgatactataaaaaccatataataataacatagaatttaaataccattagaacacaactaaattatagtgaaataaatttaaaacataaatgttggttataaacgatatttagcaattacacggagagcattatcctaaaattaaatagtatggtgaaatttatgaaaataaagtcaatagccgctaagaatttactatcatttgatgattttaaaataacatttgaggatggggatgttgttacaatcttcggccccaataatgtaggaaaaacaaacttatttagggttttaaaattactaagaaacattataaatgagaaaatatcagcagtagatttggaaatatatttacacaataaaaatttaaaagcggcaaagatagaggtagatgtgatatttgacaagagtgataaagaggttattgccaaatttcttaaaattttcttcaaaataaatgctccagatttgataagactatgtaacaacttaaagctgaacattatcaatagtattattgattatttttcagcagggtcatatatttgggagtgctctgaattaaggtgctatagaccatattttatgcttagattgagaagtttagaagaagatattgaaaaaataaaaatatacttgaaagaacgtgaattatcagagattacaccagatttaattgaccatagtaaggttatacatgagttggacagaaatgttgagattatagaagttacaaatgatttaaaaaacattataacatcatctgtaaatgcattaattacaatttatgaaaaaaatgagaaattattctttagcacattaattgatggtaaggagaatatcacaacaagaattggagatggaaatatagaaaatattgttgaaatctcaatgaaagattttacaaaagacattgagaaatatgaagattgttttaaaagattaacaatggataaaaacatattgagagcatttgttgtattattggctttggataaactcttagccaataaaatgtcaatatatgttaagaaggttttagaatattcaaaagaaaatccatgggacaaagaaattattgaagatttaaaatatattgtaagattttgtggatttgattatagggacatatatgaaattagtgatatctcactaaatgatattttattaaaaatatatgaaaacagtctaatattttatgaggattatttaccaaatgaaggcaaagtaatgattccagattatatgatagttgaattacttgctggtttaaagaataacagtttagaaaaaaatgtgaaatctaaaatattggaattattcaaaacatccacaacaaaagacgatttatatttaggtatattaagcatgccatctgaaaaatggatacccagttatttgttttacttaaagaataatgcaaatctaaagctaagaaaaagatatatgaaaattaaagagatgtttgaatatatatttaatagtggaagtcttagttttgatgtaattttagctaataataaaccagatattgtagtatattcagaagacattgagatacctctgaacatggtaggacttggtgtgaaaaaaatcttagaaattctaactttagtatttgggtatgagtcaaaggttattttacttgatactccatttaatcaactttacccaaaatatcaaaagagattttcaaagattcttaaagatactgagaatattgactcacaggtatttataatcttacattctccatatttcataaacaatgaaaatatattcaatacatttagattttataaacctaaaaaatccaccaaatacatatgtattgggagtataatcaaagacttggaaaaaacgtttgggacagtaattttagatagaactaccagaaagatattactatctgacgctgtaattcttttaagctctgctttaagggacattccattattcgacttagctgaatacgaagatataccaatagacgaatataatatcgaagttattcgcccgcaaaacactttaagttttggaaaatattatgctctacttcaatatacttccatcccatatattcttatgcttagaagttggatactttataacttatatgaagaaataaaagatggtgaaggaaaagttagatacaaactattagaaaaaggaaagtatcataaaatagtagaggaacgccttaatttctttaaaaatagacatccattttggatttctaaagaagagttcgataaagttataaatatttatattaaaactttggaagctcatagggaaaaacttattgagttaggatacatatatctctcatctaaagaagaagtagttaaatactgtatagaaccattaagaaagcagttagaggatatcttaagaaagaagttgtttatatttaccgtccctacagatttcataatcgaaccacaagacttgaaaaacattcagattgagaaagataaatatatcgttcataactatattggttacagaaaagatgtattaaaggaattcaaagaattctttgattactttgttaaattccacaatttacagtaatacaaggtgaaacagtgatattgataaaaaatgtatttgtaaatgggaagagacaggatatactaattgaaggaaataaaataaaaaagattggagaggttaaaaaagaagaaatagagaatgctgaaattatagatggaaagaacaagatagcaatccctgggttgataaatactcacacccacataccaatgacattattcagaggagttgctgatgatttacctttaatggagtggttaaacaactacatctggcctatggaggcaaagttaaatgaagaaattgtttattggggaacactattaggatgtattgagatgattagaagtggaactactacttttaacgatatgtatttctttttggaagggattgctaaggcagttgatgaaagtggaatgagggcagttttagcctacggaatgattgatttatttgatgaggagagaagggagagagagcttaaaaatgctgagaagtatataaactacataaacagcttaaataatagtagaataatgccagctcttggccctcatgctccatacacttgctccaaagagcttttaatggaagttaataacttagctaaaaaatacaacgtccctatacatatacatctaaatgaaaccttagatgagattaaaatggttaaagagaaaacgggtatggagccgtttatttatttaaactcctttggtttctttgatgatgttagagctatagccgctcactgcgtgcatttaacagatgaagaaatcaaaataatgaaacaaaaaaacataaacgtctctcataacccaattagcaacttaaaattagcttctggagtagctccaattccaaaactcttggctgagggaataaacgttaccttaggaactgatggatgtggaagtaacaacaacttaaacttatttgaggagataaaggtctctgcaatcttacataagggagttaatttaaatccaactgttgttaaagctgaagaggcgtttaactttgccactaaaaatggggctaaagcattgaatataaaagctggagaaataagagaaggatatttagcagatattgttttaataaacttggataaaccttacttgtatccaaaagagaatataatgtcccatttagtttatgcgtttaatggctttgtagatgatgtcatcatagatggaaatatagttatgagggatggagagattttaactgttgatgaagagaaagtctatgaaaaagctgaagaaatgtatgagattttgagaagctaatttttgaattcatttaacatttttatcaaagctaatttgtcagtaatttttatattttttagaaatattcctcctcttgcatcataaccaacaattaaaacctccttacctttatatttcaaaataaaagttttcctattattaactaaaatttcagctatttttgaagcctctgataaaaaaatctttaaatcctcaattttttctaagaaactttttaacttcttattcgctgattttgaagaaacagcttccataatttcttttaatgtttttatattctcaatattaattgtgatataatctctactaatccctaaagaaaaaatattcgttaatgctatttctaaactaccattttttatcaatctctgaaacaaaaataaatagttgagttctttaagcaaagtcccacttattttattcctttttctctttctttaatgggataatttttaagcctacttctccatcaatggtcaatttgttaaatacaattttaacctcgcttccactaccttctaagatttttgctaatttttcaatatctacatttaatttaggtaatttatctttaacctcatcgataagttttaacatttcttctattttttcttttgacaccatttcttttttatcttttaaactatttaaaaaacttgttatcttctctattttatcagcaatttctttaggaatctcaacttttatttctttaacttctttttcttctgacatatctatccccacaattttgttgtagtattctgcgtttatatcttatatctttggagatatttaaaggtatccatctgttcaatagctattgagtaaatctttaaattcttttaataccctatcagcatcaacctcttccatcttttttattttctttaaaaattcttttcttaattctacaacctctttaattttatctttatctaattttttagattttatatattcacttacaatttttcttgtctccttatcaattttatcagaaatattgttgtttttatttttattttcctctaaaacataaaatttaggaatttccttacttttttcaattaattttttagctatttcattaaaatcaatgtcttttgttgtatctattattaaaaatggctcatcccatttatatttcttccctggctcatcaaatttctcatacatctttttaatcacttcgtttggtattttttcccctctctcaatatttcttctaattaaaacatctaaagaagcttttaaatatattatggcatagtttttgttgtattttttggctatatttattaaatctctcctcattgagttataatagttggtgtcatcaacaataacccaatagttttttaaagcagagtctattaagcggtatgttgattttttaataaactcctcatatttctccttccatactggaaaactctccctaatcaaatcacttcctaaaactatgacatcaatgttgtttttactcaaaatttttgctaaattctttgaaaacgttgatttcccaacccctggcagccctgttaaaatgattaacatgatatcccccaaacttatttttaataggactttcgcagagataaaaattttttaaggaactgatgcctaaaggcatccaactgcattatgaaatatatgaactgcgaaagtcctatttagggtaaaatataaatatgaggaggtcaataatagtgtatagatgtggcacaatcaaggtgatgctatgagcttatcaatgaatttaaaattatgtaattatcacaactgtaattgcaatattggagaggagtattataaccacacttaccctcaattttggaataggattattgagaagtataagctcaataaaataatttcttatgacttcacttccttgccttattatagatttgtgggaatggttggagattttatttcaaaaaatatcacaacaggaccttgcctattaacaccaaaggaaattagaaagctcaaccctaatatagattttgaagaagttaagaagatgtttttaagacatccaacatttgaagattatgtatcagtggctattgagacaaataagggatataaaaaccacataataattgaaacttacgaatatgcaaaacttgttgaatataagacaaacataccttttgaagaggcattaaaattaactaaactcagtgcaaagaactttaaaaaatactacaaaaagaaagttaaggcaaaatattatctaacgcataaaaaatcatttgatagaaggttgagagaactttgtaatgagcattataaatattacttagaaaatgcaaatatttcaaagaaaggaaaagaaataataaaaaacaatcctgaagaatcaacttggttgaggattaaagtttcattccttccagaagcaataaataaagatgactctacaatagttgagccagtttcaagtattgaggggatgttattagctaacaaaatttcagaagttagtggaattgttgttagaagtcctccaactttaaacttaaaaccaattatgaatgaaggaaatgagaacgagatattttacttaaacaatgatatagagaaggaaataaaaaaactaacctatagaacaagaacaaagtggggatgctcattgtatcacaaccttttattcctaaattctccgatatgttgcaacaaaaattgcgaagagtgtttagaaatctttataaataaaattaaaatattaaaaatggggtgaaaaaatgattcacgacacaataattattggtgctggacctggaggattaacagctggcatatatgcaatgaggggaaagttaaatgctctatgtatagaaaaagaaaatgctggaggtaggatagctgaagctggtattgtagaaaactaccctggatttgaagagattagaggatatgaattagctgaaaaatttaagaatcatgctgaaaagtttaaattacctataatctacgatgaagtcattaaaatagaaactaaagagagaccatttaaagttataacaaaaaattctgagtatttaactaaaactatagttatagcaactgggacaaaacctaaaaaattaggtttaaacgaagataaatttatcggaagaggaattagttactgtacaatgtgtgatgccttcttctatttgaataaagaggttatagtgattgggagggatacaccagcaatcatgagtgctataaatttaaaagacattgctaaaaaagttattgtaattactgataagtcagagttaaaggctgctgagtcaataatgttagataagcttaaagaagccaacaatgttgaaataatatacaatgccaaaccattggaaattgttggagaagaaagagctgaaggagttaaaatatcagttaatggaaaggaagagataataaaagcagatgggatatttataagcttgggacatgttccaaacactgaatttttaaaggatagtggtatagagttagataaaaagggatttatcaaaacagatgaaaactgtagaacaaatatagatggaatttatgctgtaggggatgttaggggaggggttatgcaagtagctaaagctgtaggagatgggtgtgtggctatggcaaatattattaaatacttgcaaaaattataaaaattaaaatatttttagaagaattactaaattattttaaattattttgtgttaatgggatgtcataaacgatatttcccattttaaaatctaatcttagattttctatactatctggtttgttgaatatccaatatcccgcaatctcttgattaattccaatttctatttcatcaagtcctccaattttccaatattttttatctccagaaattaaacacactcctataggagcaaattcatatgtgtcaggatttaagtttttagctacaaaatcaactctaaatactttttcaattctgtcagtttgattgttataaattttataatatccatattcttttacagtgaattttatccccacaacatccctaaattcttctatattagtttttattgagttttcatgatattctttttcaaatatttctttcatttcttcttcagaatatctttcaattgttccataggttgtttttgataaattcacattatcatttttaaatgtcaatacaaattttgcatttttataaaagcctttaatttttggcaattcaatctcatagtaatatccagcttttaagggaagttcattaatgtagtatgttttattaaacaataatccactatcgtcaaatatcttcaatacaacctttccattacttacccttgctaaactaccgttctcataagctaaagcaaactgaatttttgttttgtttccttctttgacaatatacatatattttatttcttttattttagctaattgatttttttcagttttttgaattaaactttcattttctaaggttttgttcgtttcaatcttatttatatttatttcattatttacatttgttgttttattgcttgtgcatccacacagcaatacaataagcataacaaaaataaagaacagccttttcatactatcaccaaataaaacaaaaaatataaaaaattaaaataaaaaaagaaaagttaagttaatttactcttttaatgctggaataaccttcttaccaattaatttaattgctgtttctttgtttggtccaattggggaaccagcaacgatttgagtaactcccatctcagctaattttttacacttctcaacaacatcttctggtgttccgtagattgagaatgcctctaacattgtgtcatcaacattcttgaatgcttctgggaagtttcctgattttaaagcgtttcttattgcctcaactttctccatgtcaattccatgtctctctaagacaactggtggagaacctgctgcgatgaatgcaacaactggaactgctgcctgcttagctttatctgcattcttatcaactgacatacatgcgtaggcagcgacatcaatctcgtccatgcttcttccagcagcttcggcacctttcttaattaatgggattgctgcttcgaagtcttttgggtttgatgcattaattaaaactccatcagcaatcataccagctgtttctaacatctttggtccttgagctcccatataaacaggaactgccttttggattggtttaactgctaaagcagctcctgcaatcttgacaacctttccttcataagaaactctctctccagctaacaactttcttataacttcaattgattcttttaatgttgtaactggcttaacccactcaattcctaatgcatcaaaagtagccttatctcctggaccgatacctaaaacagctcttcctcctgataactcgtccaatgttgcaatagctgaagctgttattgctgggcttctaacgtatgggtttgtaactcctggtcctaacttaattttgtttgtgttcattgcgatagctgttaaagccatatagacatttctgttgttgtagtggtctgtaatccaacagtattcaaatccgttgtcttcagctaacttaacatagtaacagagcttttgtattggctcgtttggaacaaattcgataccaaatttcacaatctcaccctcaattttgttatttaacaacaattattatattatcaatttatggtagtaattaagttttctatttaccgcaaatcgaaaaatatttataggagtaaagatttttgatgggggtattaatttatctaaaaaaatatttaatttcaagaaaaaacgtttaaatgccaaatcatttaaataatataaataataattaggaagtttatcacaaatattgtaattcttcaaatcattatcttaaattctaaacatattataagtttaatttgaaggtgacatttatgaatcttgaagagaggaaaaagttagaaacaaaatctattgatgaattagatttaattggaaaaaaagtttgtgtcgatacctgtgtcgttatagatggtagaataacagagctaattgagagaggtaagcttaaagatgctacaataataattcctgaagctgtggtttctgaattagagtatcaggcaaacatgggtagagagataggatataaagggatagaagagcttagaaaactaatagaaaaagcaagtgagcataacattaaagttgaatactatggagaaagacctacaagagaggagatatttttagcaaaaagtggagaaattgatgcaatgattagaaaagtagctaaagaaacaaactctatattattaacaagtgattggattcaatacaacttagctaaggcacaaggtattgaagcatacttcttagaggctgcagaagaggaagttgaacttgtattggataaatacttcgatgaagaaacaatgtctgtgcatttaaaagagggatgtttgccttatgctaaaaaaggtaagcctggagaagttaagcttgttccaataggggataaagaactgactaaagaagagatggaagatataattgataatattataaagtatgcagaacagaataatggattctttgaaattcaaagaaaaggagctacagttatccaattaggaaatattagaatttcaattgcaagaccgccattttctgaggctttagaggttacagcagttagaccagtagttaaagcttcattagaggattatgaattgtcagataagttgatggagagattaaaggagagggcagagggtatctttgtttctggtcctccaggaagtggaaaatcaacgtttgtagcggctttggcagagttctatagaagccaaggaaaaatagttaagacaatggaaagtccaagagatttgcaagttagcaaggagataactcaatatgcaccattagagggagatatggagaagacatgtgatatcctattattggttagacctgattacacaatctatgacgaagttagaaagacaagagactttgagatatttgcagacatgagaatggctggagttggaatggttggggttgttcatgcttcaaaaccaatagatgctatccaaaggttgattggaagggttgagcttggagttattccacaagttgtagatactgtaatctttataaaagatggaaagatacagaaggtttatgagattgacttcacagttaaagtgccttatggaatggttgaagaagatttagcaaggcctgttattgaagttaaggactttgagactggaagagttgagtatgaaatctacacctatggagaacaagttgtggttatgccaattaaagaagaaggtggaaaaaaagccccaatatatggatatgctgaagagaagttggaggagatattgaaaaaacttctaccaaggaaagctaagcctatggtaaaggttactggagacaactcaattgatttaattgttccagagaagtatataggagctattataggaaagggtggaaaagagatatcaaaattggaagatatgcttggattaaaaatttcagttaaagaaaaggagaaagaagaagaaaaagacatggaaaggatatatagaaagtatgaatatgtaaatgagcttgaatcaacaagaatttatgagacagataaatatgtggtcgtggatgttggagaggactttgcaggagaaaacataaggatatacatagatgggaagttattaacaacagtaactgttagaaatgacgggacagtgaggataaacaaaaaaacaaaggtaggaaaagagattttagaagcaattgatgaaggaagagacatatatgttgatttgcaataaaaaatcctatcttaatttttaactatctctaacgccttttttaaatcaattaaacctttatatagtgctgaaccaataacaactccataaataccaagttcttttaaagcttttatgtcttctaaggttgtaattccaccagagtagatgataggaatatcagtcttttcaattaactctttaattatatcaacatttattccttttaataagccctcaacatctacatttgtaaataatatatagccaaccttatcttcaaattccttaataacttctattggagttttatctactttttccttccatcctttaataacaacctttccctctttacattctacagctaaaactatcttatcttttccaatctctttatttaaatcatctatgaattttggttctaaaattgccttagttcccactataactctatcaactcccaagctaattaattcctttgctatctctaaatttctaattcctcctccaacctcaactggaacattaacctcttttataatgttcttaataacgtctctattatttcctgttccaaatgcggcatctaaatcgattatatgtagatactcagccccttcatctacaaattttttagcaacttctactggattgtttagttccaaatgctttttatttgggtctccttgaattagctgaacgcactttttatcttttaaatcaactgcagggattattatcatttaaatcacctatatgaataagtaatgatattgtttaggtttttactcttatttttccagttagtagtagattcattattttcttttttgctttttctatttgttctttttcttttctttttatttctattaaatcatcaatggcttttaatcttttagctattgctttttgttcttctaatggtgggagggggatttttatactttctaaatcttttttagttattgctttgaatactgcacctcctcctaaatattctatttttggctttatataactcaaataataaaatacaaagaaattatctactttttctttatttgattttattcctgctaatcctctaccgatacaaagtttaaacggtgctatatttacatctccaactggagccctaactgaaattaaaatatcttcatcatcaacgacttttaaaggtttatttgtgtataatactggattaggataaatatttccaaattctgcttttccttgtaaaaatggaactccttcaccttctttattataggatgatgatggtggtgattgtcccattataattttgaaatatttttcatttcctaactcaacaacctcccaatcctctggaatctccccaatttcagattttttaaaacttttatgctcaaaaactcctttagtaaataattttttcatcatccccttttttgccttatttaatacttcaatctgcttatttattgttcctattaggttatcaaagtcacttaatatttttgctatttgtttctgttcttctaagggagggagggggatttttaaatgttttagttgtgtttgatttattgatgattgattaactgctctttttgctatatatttaaatatatttttttgtttaaaatgcctcaataaatataataaataataaggctcaattttgtttttgttaggtctaagaagtagtaaattcattccatgaagtaaaaattcgggtttcccttcataaattgctacttttccaatatgttcctcactatttatatgactgaataaaatatccccgataattaatctatatttagcaatatcctcttgtttaatatcttcaacataccctaattttgttatgtctattttactatcagaaatcgtttcaattcttgttattggataacctattttatctttattttgcttagcagttagtccatttctgataacctctaaaatgtcttttaattccctaacctcccaatcctctggaatctctccaatctctgtttttttaaaattctcctctttataaaattgcaatagaatcaccacaacgttattattaatggccctttagcatttggtttcttttttatcatcaatatggcgtcttccccatcttcatagtattttggaagaagctttctatctctataacccatcctataataaaatcttctcgccaggacatttgaaaccctaacctccaaaactatgtagttacagttagctatattgaaataatagttttcaagtgtttttagtaaagctgttccaattccaagccctctacattctttttttacagccaatgagataatgtgtccattcccccaatccatacttcccaaaatatacccaacaaccctcccatcaatctctgccacataaaaacagtttggatacattgaccaaaatcctaaaattaagctggttggataaggggttttaaatgcctctctctcaatttcttcaacagcatctaaatctttagatgagaattttcttattatcatgttctcacttaacctttagtaaagcctttgaataattttaatcaatgaatgttgtgtaatttattaaattctattttaattttagtattattttaaattctttttatagagtcttttaaaacattttgaaatactaaggaccaataaacaccccctttatgaaagcgttcaaaattcattaatagactttattaaatttgaaagacaccatatttaatctttctctctctaagataaattttttcttgtctaatccataggaataccctcccaatgaatttttagcaacaactctgtgacatggaattattaaaggtaagggatttctttttaaagccattccaacagctcttggtgaagtgtttagttttttagcaatatctccataagttaaggttttcccaaattctatgtctttaacaatatctaaaaccttttttgtaaattctggaacttccaatttataacttattaattccctcacttttttatcatcaatttctgcaaaatataattttaatataatttcagctacttttaaatgttcatcttctggattgctaacaacctccccatccatgaaattaaatatctcttcccttcttaaagggattgtatttctaaccaattgattacctttaaatatcatccctataaaatactcttctatctgaataatcatgctctcacggtgaaagcctatgttgatagtaattaactataaaacatacaatgaaagtataggaaatagaggtttagagatagctaaaattgctgagaaagttagtgaagaaagtggaattacaataggagtagctcctcaatttgtagatttaaggatgattgttgaaaatgtcaatattccagtttatgctcaacatatagataatataaaccctggaagtcatactggacatatattggctgaagctattaaagattgtggttgtaaaggaactctaataaaccattcggagaagagaatgctgttggctgatattgaagcagttataaataaatgcaaaaatttaggattagaaacaattgtctgcacaaataatataaacacttctaaggcagttgcagccctaagccctgattatattgctgttgaaccaccagagcttataggaactggaattccagtatcaaaggcaaatccagaggttgttgagggaactgttagggcagttaaagagataaacaaggatgtcaaagttttatgtggagctggaatttctaaaggagaagatgttaaagcagcccttgatttgggagctgagggtgttttattagcttctggagtagttaaagcaaagaatgtagaagaggctataagagaattaataaagttcatctaagttataatttatttttcaaaacttaataagattctaaggaaactttgaacatttatcttataagtaaggtgttcattaagtatcatttattccaaaatattttgaaaagctatctcttaaattttttggtgagattgatggctttgggattggataggaatatggagggagttttatgctatttgttattttggattagtggattgatatttttgttgttagagagggaagatgattttattagatttcacgctatgcagtcatttataacctttttaagtttaaatttaattgccataattgtatctgcaattccaataattggatgggtagcttccactttaataaacatagccataattatcctatggattgttgggatgattaaagcctacaatggggaaagatataaatttccagtgtttggagatatagcagagagatattacagagaatttttgaaataaaataattttaaggattattatgtggttcaaaaaaaggattataataaaagagacaaatatactcttaaaggttgatgataaagggtattttaaaaaggcggaggagattattttaaaaaatagattagagttagagaggtatatattaaaaaatccctattttttaacatcatattttccagttgatgtagaagatgatgccccagaaatcgtaagattaatggctatagctggagaaattgccaatgtaggacccatggcaagtgttgctggtgcaatagctgagatgttaattaaaaatctcaatgccaaaaacatcattgctgaaaatggtggagatatctgcttaagggctaaaaaagacgttattattggcctatatgctggaaattcaaagattactggagaagttggatttagattaaaaaaagagaagattaaaaatatctatggtgtttgcacttcttcagcaactgtaggtcattcagtaagctttggagaggctgatgctgttactgtctttgctaagagctctgctatagcggacgctgcagcaacagctatatgtaatgcttcaagaggaagagatgaagaagagatgataaacaatgcattagaaaaagcggatgaaataaaaaaaatagatggaatttttgttgttgtaaaagataaggtaggaattaaaggaaaaattccagagttagtcaagacagataaaagaataaccttgggagagctgttcgatatttattaactcatcaaagtttaaaaagtttattttagataatcagttccataatctaccttataaatcttaaatcctggctgaatgccaaagtctgttgggtctattgtagctttaaccagctttatatgctttaatccataaccatctaagaagtgtaatttagcgtagatactatcttctaagtttcttgttgctaaccaggcataccctcttccatctgcttctattctaataaactctgataactgtccatctttatttaatacaagttccttaactcccaaaggtgttttaatatacaacttgtgtatcttaaatgttccaatgatttttgcttgtccatttattttttgaacaattgctgttgaaatgttagtactatttattaatgtgacataactatatgtatagacatttacatttgctaagattgttccatttcctaaatagtaggcagttcctttaaagaacgctcctttttccctcttgtcatttggagtgtttggtggtagagagaaattccagaatccaaacatactccaaactggggcaatatctgtcattctgttgtatgttattaaataatctggatttggatgttctggatgggttgcatttagaactaattttgcttttttatcactcaacccgtattttttagttaatatatcataagctttacttctatctactggcaatatttcattcaatatcttaactgtctttgagacattgttgtgagtgaagttcattagaacactgccttttttaaatgcttcatctccacttgttgctaacatcctaattattccgatagatagattttcgtttgatgtcgcaaaagctcttcctacccagtaagctcttggagagttttgactacctccatcaaatgttaccattcttcttgcctcataagtgtagatgtgcccgttatcccaccagcaggttataactgagttgtttggagtatttgcctttatccaatctaaaccttctttccatccgttgttgaaggttggggcaacagaaaatggaactacggcagataatggaggtataacgactccaatgcaaagtagtaatgtagaaacttttattattgtttcttttttgtcatttaatgttgagattatatcagatattttgtagatagctaatagggctaagacaattaaaaatccataggcaattataggaacataagtcgttggtaatagtatttgagagatttttgcagagtattttgaaagtattaataatccaaatattccagcagggatgccaataccaaatattgcaatatcgcttttcatttttaagaatctctctaactgcccaacaaatatccctaaaccaattgccaatggaggagttgctaaagctgcaaacctaattccttttgttgctgcatataaagttactgctaaccaaatagccaataatatagaatattttatatccaacttaactttttcatatcttaaagataagaatgataaaagtatcccaagtattccaacaattgctattgtatctgaaccaatggcatttgtaaatatctcactccatgagcttggttttgcaagctctgcaacggttgtataaacgttaggccaaccagttgtttgagtgtaagttgaaagtatttggttataacccagaggtgaagtaattggtgaaattgctatccccataccatatattgctaccaataatacaaatgacccaaatatgtaaaatatggatagatagacaatgtttttaaggtttccaatattaataaactcttttatttttacctgtgattttaataatgctaaggcgatgatatatattactaagaaagcggttattacatcgaatccataccaccaagctccccacatttttggagacacagctgttaatattacagccaataaagcaaataattcaaactctaattcattacctttcaattttttaattcctgctattattaaacctgctaaaataaatgctaaagatactgtataaaataatattgaagcgataactacactttctcctgaagcgatatttaagtaagctccaattattaactcgattattaatgcagcgattacgaataaagaaataggattctttaaatcctttttaaataatgcagttttttcctggctgtgtattgactcaagaataaaccaaactataaagagtattggtagaacttcaaatattggtgtgtctgcaaatccagcacatgttttgtataataaaccaggagccgatattagggctatagccccagctatccctccaatgttactatttgtaactctcctaaccacgaaataaattggtattcccaacaacatccccaacactgctggaacccagaaggcagcattcataatggttacagtcaaatcaatagaatgccatatatagtagatagctaatgttgctaaacagataactggtggttcccaaggcagtggatgtcctggaggagcgtattgatataaatcataaggtgtttcttttccatcaacaacttttattgtatccccacagtgtccgttattgtagagattttcacttaatcttaagtagtagtaagggtctaacgctaaaagatacatccttccatgttcatctgaaaacatatcttttaaaaattcgttatcttgggcaaatttcatatccgctgtttgagccctcaactgaaaacttacaaacatcaacatcaaaataattaaaaatacctttatccagcttttctctttgaaaaaattgtttattttttctaatgcattactcataagtttcacctttatatacatgacagtcagttattattatcaatccgttattttttataacttcatataacttaggtaaaaccctatttatattttcttcaatatcaacacattcaataatcactgggagatttacagatagcctaaatatgtcaaactcagctactcctctaactccataaccacatattcctttatagacagtagccccacttatcccctccctttttagtattttcataatatgtttatacatcaactctccttcaaatttatctccttcccttaaataaatttttaagatttttgcctttatcattatttcacctacctaaagatagctaaagctaaaaccctaccaaaataaaccataatcaaacagccaactacattgattaatatatttagtagagctttaaataataatccttcatcaactaagacaaaggtttcataagaaaatgttgaaaaggttgttaaagctccacaaaatccagttccaatgaataatttatattcagttggtattggagcgaataaagagcagtataacaaaaatcctaagataaaactacctattaaattaactgctaatgtccctgttggtaatccaaactttactggaacaatcccgctgattaaatatctaaaaatagctccaaaaaatcctccaacacctattaataatagttccctaatcatcctctcctctccaaccttttagtaaaaggttgatcaaaacttaaagtatcattaactgtcctcactcaaatctcttcgtctccctcataaacacaaactgttaaataagagaaatctccattagctatttcttttaaagattttaagctaattttttcattttcataagttagattttctaaaacccaaatttttgtgtctggatttataccattatttattaaaaacttcgcatcctctttcaaattgtttggtaagaagataactttctcatgattttttatcaaatttaaaagctttttcctattttcttcttttccgtggagtgttattatataataatcttcccaggagatttttaattttgcagctgctatttgtatagatgaaattccagagatagcttcaatatcttcttttttagctccaatctttaataatgtttttaataatccactaaaacatgggtctccagttgataatatggcaatctttttattttttatattttcattttttattagctcttttaactctccaattaagttttttgttagagttatttttttatcttcatctatattaaataattctaaagcccttttactaccaacaaccaaatcagcattttcaacaatttttattgcttttaaagttaaatattctctatctcctggtccaattccaactatataaatcatagtttcacattcaaataatttattactattatgtttttaaatatcaataaaattaaaaagataaggtaaagatatcagaataagaatataaaataagaatataaaaatataagttaaattttgaattaaaaatttaaaaattgaaattaggaggttgaggtctttcttttcaataatatatttgctaatggttttgcccatgaggcttccaagacaacactgactattattgtcataaaggttgctactaatatagttccagcgagttctgttggaggcattaagcttgctatattttttggaactatgtttggatgtttcataatctctgtataaaccattgctgctaacgttgctggaactacccctctcggcccttctaaagctaaatatatcctttcagtaagtggtctaattggtggaatagctgtagctatcaaaacaccaacaggtcttgctaaaagtatagaacccaatgcacataaaaatgcagggagtgcatatttttctaataatgggattgagatacttgcccctaataatacgaagattaatattctgataaatatggagagttcatccataaacactgcaaccttttccatatcttttttatgttcttttttatgcactatgacgtttccaatatataatcccattatagccactgccataaatccactaatttcatagccagttattgatgggaaaattccctcagcaaaataccaaaaggcaatagccaatcctaaagtaaatggagcaatatagtcctcaaacttaatttttgagataataatttcatagaacttgcctgctataacccccaatattatcccaccaacagctaatgagaaaaattcaagaattggattctcagctttagctaaaccaagggctgataaacatataagtgttacaacaatccctaatgggtcgttaaaaacactctctgcttctaaggttattgctacttctggntcaatatccatgcttgagaatattggtattaatgtagcagggtcagtagccgaaacgatagccccaaatagcaatccaatcaatgataagattggaagatgaaagacaaagttaaatactattccagatataatccaaacaattaataaagccagtatatcgagttttattataacatccaatactctcttcataatgttccattccatttcaaatgaaccaataaacaacaatataattaatccaaagtttccaataaaatcaaaggagctttcaacaatattttttgggattacatttagtatagaaagtatgagaccaaatattagtaatagaggaatatcaggtatgccaatctttttagcaatttttgctattatggcacctccagcaaaaagaatagataaatagccgagaaataatacaatattcacaatcccaccaatcttttagtttttaatatctggatatacagacactaaactttacatttagaaagcatataaattttttggtggtaatgtgaatagaaacgattacgatgttgtgattatcggtggagggccggttggctgtataactggagagtatataaaaaatggtagggttttgattgttgaagagcatcaatctataggtgttcctttgcagtgtgctggcttaattagcaaaaatggggttaaggagcttggtaatcctaaaggagtagttaataaagttagaggagcttatatatattccaaaaatagcatggtaaaaataggcaatgagggaattagagcttacatttttgagagaaaggttatggataaagatatagccattagagcggcaaaaaaatgcgattttttattaaaagcttatggaaaaattgagaaagataaaaatggttataaagtggaaataacccacttaggagaaaaaataaccctaaatccaaaaattattgttggtgctgatggagctaaaacaataactggcaaaaaattgggcttagtaaataacaaaaatagagagattttatcaagctgtcaatttgaaatggtcaatgctgaggtagatgatgattttgtttatattttcttggatagaaaatattcagagagattttttacatggattattccaatggggaaggatagggttagggttggtttgatagatagaggaaactgctacaacaagcttataagatttataaatgaaaataaaatagctaaggagatattaaaaaatgctacaataacagaattttctactggctctttaccaattggttatttagataaaacctttaaagataatgttttattagttggagatgctgcctgtcatgtaaagcctctaagtgggggagggttgtattttggagcaatgggtggaaagatagcaggtgaggttattagtaaatatttaaatgaggatatagagaatttagagctttatgataaaagatggaaagaaacatttggaagtgagataaaaaatggtttgagagttagaaaattgtttttaaagctgggaaacgatactttagataaaatcattgagaaattatcaaaaagtgatttgattgattatataaataagcatggagatatggataggcaggcatctttatctataaaggttttaaaatcattagatattggattaggatttagaattttaagggatttgttataaaagaataaatcataatgtcatttttagaagtttaagaaatttgttgcagagtttttagtttttccaatacttgactattattttttaaatcctcagatgttgaaataattaaaaccttgtcccccaacttagtattttcattaatttctgagagtttaattatctcaaatccattttgtttatatatgggttctttttcttctttctgtctttttctatacttttcattttctaacataccataatgttcccaaagaattgttctattttttatatttaatttgaagtcaggaagaactccaatttttaaatattctgatagtagttcataaatatattctattcctacctcatggaagagatttgccaatacacattcttgccaacttctaactttttccccatttattgttataatttgtctattttcaatataaggaactaaatatgaaatgttaaaattttcaaggagattagtttttctccttgctaagtcagaaatatttgtttctaagaagtttttaagctcttcttcaacaataacatacaatctttttttagctcttgttattgcagtatatagcatttcttttgagacaaatttgttcaatccttttggaattattaagatgacattttcaaatccactaccttgacttttatgaattgttattgcataggcatgttccatttctttttcatctgtatatgcttctatttttggatagtagaaccttataatggttttattttcatattttttctggtatttgttccattttttgaaagtgtaggcgaaacccatcattccattaaatacgccatgttcttttacccatttccttctttcagtatcataaacccattttttgtaattgtttctaatttgtataactttatctgcaactttaccatctccaaaaaaccaattctccaacattttatttttatatttgtctggaataaactttgattcctgttttatgaataaattaatcatatatgaaccaaattctcccttagtttttgttggaactaaaatttgtaatttatcattaaaaactgcaaagtcaaagaaatcttctgtattattttcttttagtatggtttctatagcattctctaacgattttttaatgtttccatctttaacaacttctattgttattatttccttttctatgccaccaatattctctttaatcctatagatttcattatctcctaaagtttctttatttttaaacatttcattcaaaatttttattctttcttctttatcaatatctaaaaacaattttgaaagttcaacaatcttcttagagtcagcccttaagacaatttccaatttacatattgattgtggattaactttttctaaatagttataaatgtcatagaaaggttttccagcaccaactggtggcaattggttaatgtctccaacaaatattaaatacttcaaattatccaattttattgttcccaataatcttcccattgtttcaatatctaccattgatgattcatctataattaaagcatcaatttctttcttgtcattaccagttattttatccaatctaaggatgaaataattatctccctcaaaataatctttaaattcctctgcaatatatctatgtattgtttttgcagttgctaaattatttaatttttcattaacgaccattgctgactttccagttggtgttaatatgtagattttatttaatccaagcacttccttcattaattccataattgtttttatgaccgttgtttttccagtgcctgctggtcctgttaatattccaactctatttttaagtagatttacaactgcctcagtttgcatatctaaagctttttcatattcttcattatcaactcccgctggttttttattttcgttttttattcttaatttttctctaatttctaatggattcaaatcaatatttggagctttcgactttaagagataatttatggtattttcaattatctcctcatattctctaatttcttttagggtaaataattcaataatttctttattttcattatttttaacttcttttttgactatttcaactttttcagatattatgtctttatattcctcaattatccttaaaaattcatcaaaagttatctttacaatgtctttatccattttttcaaagaaatctttaaggtcttttgttgaaattgtagtgtttcctgaacttaaatgcctttttagaatttcaaccaataaagctctaactctatatggactgtaaggattaaatttatcccccaatcttcttctttcccatgagtcaagctcttcaaatattatcctttcaaaactatcattttcttttaaatcctcaaccaaaatgtatggattttttattatgttatctaaattaataaattctttttcatattgttccttaattttttcaagtttaaatgcagataactcataataaacagcataattttttaaaaactctctaaactcttccttctgtgctataaatttgtctataaccttttttgtaattccaaactctaaattttcttttctattttctaaactttcaattaatgcattataaagtttctcttctcctttttctccttcatttttccaaagttcaatatatcttgagtaagcatcttccattcctaagaaataaagaactccaggaagtccaggatatttatatttactaccttcaagttctgcaataaccttttttatattttcagcgaattcatcaaactttttcataacatgaggtctaaatgctatattctcatcagttaagtatttatcaaagtcctgattttcttctctaaatttattgaattcctcaacaatttcaagcccttttttaagaatttggactgccacctcatcggatataaagttagacatgcctttaaagtatctttcaaagtccccaacttcaaaaattaaattaaattcttttagaatttcttcaatttctttatttttatttttgcagtattctaagagttcttgataaggtaaagcaaatattacatcattctctacatcaaaaacaatgcctcttcctactctattaggactctgtttttttctaatgtaatccttgctaccatctattatttcctttattttaacacatccgactattactctattttcagataaaggattttctctaacataaagtattgcgtattttccgttaatcattcttaattgttcttcaatttctttttttatcatttttatttcatgttcatttctgttttttctatcaacataaaatattgctggaaatcttatgttatgctcctgtactttccctttacaaaatactattgcttcactacatgctctttctcttgaatttcctaaattagcatctggattatttacacaaaattcatactttctctttcttatcacatatccaaagctctcacaatatttattttcttttggatttctacaaactctaccattccatccagaatcatgccacgctatcaaagatattaaatttctcatgataccacctcagctttattttaatattaagtagaagtaatatttatattttttaacttttatttattaaagtattttacaatcttattatctatataaacaaacctaataattatcaaagaaacatatcattaaaccccaatttcctcaaatcatgtagagttatattattagcctcacttaatttcttttccatctctcttagctcttcaacaaactccttcaacctcttcatattattataaaacacatccttttttgattctctaacaattcctctaataatctttattaactccttatcaaagtatctaacatctatcttagatgatttaggtaaattttccctaatattcaacaatgtctcaataatatcatactctttaactttaaaacctccatttctcaaaattttgaaaattacatggttaaacatctctttactaccatctttctccaattcttttgtataatcatatagcaaacacatagcggctatattttttataaacttaaactcatattctccaatgttatcaataaagtcataataccaatcaaaatatagatattctattaaatttttaatttcatctgccaatttttctctttcttttttatcttttgataaatataaattataaaactttgataggcaaataatcaatactctttgctcattttctctcatacttaatatatcactcttaattttctcaatgtaggcgtttattatgtttaacctacgaataatgtcatctggaagattgttattagctataatccttctatagctattaatatcttctaaacttctattaagtgaattgtaagtaattctaaggactttatcagttaacaccactaattcatgcagttttttaataatttctaattctttgtcatctatgctttccgttcttagtatttcgttagatactaccttaaatattatctcaactgcattataaactctctctttgattgttaaagactcatcatcaattgtgtaaatattatattctaaatcatccagaattttgttaatttcaaatatatttccactttttaattccatgataagatttttaatatttttagaaacattttcactcaaatcatgtattttgttagtgtaatctggaatgaaaattatgcgaaggaatagttttgtcatgtatctatctacactgtcgatttcgtcttcacgaggttttgaaccaaagattatactaagcaattcagcccacttttcttttttcttttcaatagttggattagattttttacttttaccaattttactaccatactttttgtctttatatttttccttcttattaaagcactctccactgaaatatccagaatttcctggcttttcaaactcaacatgcccaacacttccattatatttttattaacatcaatatccctaactaaccacccactaaaccactcatcatcacaaacaaccctcttccctaaatcaaaaactcctccaccatctaagatgttatctaacctctcattaaccacatcccccatcaatataaaagtataaacttccttaccatttaaagttgtcttaaatatcatctcattcctaatttctacttgccaatcaaattttttagccattttataaaactcatcaaactttggctttaactctttaggaattactaaagaaactccaatattcatccaatctctcaatctattccctaactttatctcctcatctcttaaattatatctattaccagcaaaccaatttactacttccaataaccactctttagcatgatttcttgtgtccaatcccaattttattcttgcaacaccatcaataaactcatcattagttaaaattctattatgataataattaaagacatcatcaaatatctctaccttataatcccctctttttgtatattcgtcaaataatactacaatctcattcaacgtttcattcaatggcactctctcacagccaataacttcaacaacttccctatctttaatcctctcactccacaaattcataagcttcaccattttacttcaccaattccttagagatgtaatagcccataacaataggaaatatcagaaatccaataagaatcagcaattcaggaagaaatatgacaaggagtagtagtgtggatgttgttgttagacacttctttttgtctttaaatataaggcgtggtagaattactggcactccaatgattccatataacggccataatggagctatagaatacaacaccaacgtcgcaaaaaaccagcaaaaaattcttaacattatttttagaaatcccatactgccaccgaatattcagtcctttaagaaatcgaacagcatacccaacatagtaaaaaccatcaataatgcaaataccgttaccacaagtgcaaatactcccattcctacctctccaaagttagaggagattaatccatcaattatcatcccaatacacaagactgaaaacattatccctcctataataaagaaaatacacgctatcaggaatattataaccattacacttattatgagttcaattaaatccaatatcatcaaatctcctccaaaaaattaaaaattaatcatctttgctgaagattattgaataaagttgggcattgtaatcctttgctgacttgtaggcatcataaatgctataaatccatggtataataagccagcatgttaataacaatattattccctttccaacccttccaagatacatttgccctgctcctggaattatgaagctaagcaatactgcaataccgacactctttttcttctgctcataatacacaattcgttgatttttatccatgtcttttacaaaatctttaatttgcattagttctatttcattcatcgccatcacctcaattctattattaaattaactcataattatcctatttcttctccatctaaatcctttaagccttttatcaatctctaccctcttttctggtttagtataaaatgttgcctctaaatcatcccaattgacagtgtctctactatcttgcttgatatatcccttatccaacaaacttctaatcccaattctcacaacggaagcatcatgtcttatatttctggataaatactcaagattttcaattattttctttaaactgactctatggggactttctctaaggatttttaagattttcaattccaaatctgtcaatctcttattagagtaaatcatttccccatttttaaacaccataagttctccattttcaaaagacttccaatcttcattagttagaggatttgtagctataataaacccttcttctctcacacttttaacatctcctaagtttataatataatcctcatcctccaatctaattcttccataaggtggctttctctttaggaaatgcaactctctcctccctctataatctttataggcaaataaatactctccatcggagaataagcaattaaaagctccatagtaattaatatcaagcagtatatccaacatctcatcaaaaccctctttattccactcaatctccctcttttcaatttgagataataaatagcagaatacatactccgaatccgtctctccaattggataatagccatcaagctctaaatcctcatatccaagtagagttccattgtgagcaaatgctatttctttatcttctaattttctaacaaatggatgggtatttacgtaagattcacttccagcacttgcctttcttatgtgggcaatgaatatatttgattttatcttagtccatctgacacattcagctaataaagcttcattcattttaatcggctcttttattaccctaacaaacccatctggataaaatgcaatcccccaaccatttggatgatcttcactcctatgcttaaagctatttaatgataactcaacattaactttcttattaaagcaaattccaagcaactcacacatgcttatcccctataatccttataatctccagattctaccagaattccacaagattctggataaaaataaagccaagcctctatctcctttccagaatctaaaattatcgaaactttctttcttctataataatcaggatgtccttcaaggcagtcaattctttttaacgttttttcatcaacctcataaacttccccaacgatatgagagattttttcattttcaacaacataggggatgatattgacatacatagcgtatttttccttagtttttccttttccaatgaatttagagttttttaaatatggttcatgattccagaagccctttcttaaactcccataaacaaacacatactccatagtatcacaactttggttttgtaatgctcatgaataatttaatatgagagagtataaataatacttactatcttagtaaccttaatgtagttactgtccttactaaaggtgagtaaaatgacaaatgatttagagaaaataagaggtggagttcatatagcagttcaaggttatgaagtagatagaattacagaagttccaataatgaggagggctgaaaaagtttatttaatttgcaaacctggaaataatgattcaaaacgaggaaaagcatttaaaaatgttattattaaaaagtttgaagaaaagcgggttaattatgagattgtagaggcagatttgtttgatttagatgatattgttaaaaagatgaagttaattatagctcatgagagaaaagaatttggagatgttaaattctatattaacgtatcttctggctctacaattgggtgtattgctggcataacctgtgcaatgatattaaataaggaaaattcaaggattattccatattatgtaatgccagagaaatctttagatggcctctctgaaaaagaaaaggaagaattaaaaaaagaatatgaaagtaaatataactgcccttatttgccaagaagttttggcgttagaggtgttaagctaatctatccatttgaagtaactttgccaagggaagagttgctaatatttttgaagttcattggcagggctggaaatagaggattaactataaaagaacttagtattttaacaaaagaagagtttttaaacgtggatttaaatgataatgagagtataaaagagttaattaaagcagtggagagaaaggaatctgttagcaactcatctgttaaaaaaatgaagaatttagttagagagttaaaggaggtcgttgggagtgatgttgatgatttgaagaagattattacttggaggaaaaagtgtaggagttcagttagttctactgggcagagtgatttggtttgggttaataaaaatgttgttgaaaaactcttagaattggaattgatagaaaaaccagaaaaaataggtaagtcaaaatatataagaataagtgaaaaagggaaaatgctactgaactacgttggataattcactatcttatactcaaaatctcctcatgtaaagcttttagcacttctatgtaatcaacttctccattttcaatcttatccataatctcctccaactcccttgttctctcttcagatattaagtgaggataattgtttatcaaataattatagacttcaattcccagctttgttgggattaacttattcttatctttacttttaactacgtatcccctatctaacagctttttaataatttgggcataggttgaaggtcttccaatacccctctctttcatcaacttaacaacctctccctcatcatacaatggaacttttggaatctttctaagttttttgtctaaaacttttaaactgctcttttcaatccttggaagcttttttaattttagattataaattctactccaaccatcaaactttatatcaacatatccctcaaccttctcatctaaatcttttatataaatctcttcatattcaacaacagcctctttcatctgagaggctataaatcttctaaatatcaaatcataaacttttatatgatttttagttagctttatgttattttcctttaaaaactctattaactcatcggtattcattggttttgttggtcttatacattcatgagctccttccataaagtattctctattttttaaataatcctctaaattgtttagttttagatactctcttgctactctcatcccatccaatgaaactcttgttgaagaggttctgtgatatgtgcaattgtgtgagataactccatttgatataaagttttggttatgtttaatgcttaaatcatagacatatccatcataaggaatattttctacttttttaactctaacaaaggatatatctccattaacaatcttttctaaaaactctttatgttctgaattatttgcatatcttagcactgtctttaatttttctcttgggatgttatttgttttctctttataccaattttcaatgtgtattttgctatcttttagaatttcctttcttcccttttcaaatgttaatttcttaaatacctcttttactggcaataaatcacattcaaatctttcttcatgctccttcttatatgttttataaccatttataaatgcctcttttctaatctttaaatatttcgcaatcttttccttaaaggtttctaaggacttattgcttattattaaggaataaacttctctacttttgtgtaaagtatttagaataccaattgagtttagataaatgcctatcttttctaaaacatctcttctttttgatgttaaaaccattcttaaattatgtttttttgcctttttatcataaagtagggagaagcatccatctgtatcaaaatatccagcaattaatgcatttatataactttctgggagagagaagataattccgtttaattttccatttctcattcctaatttttccaaaatttcagcaataattggatttgaaataatcacttggttaccagaaatccaattgtgtaagaatgggaatgtctcatccaatatgcttttaacatcctttaatggtgtttgtgcaattctaattttgctatcttgaatgcttccatctcccaataccaaacctgcaaaataccaaaacctctcatctaacttaaacaatggaatttttttagttcctgcaacgcttttatatatgtattttgcctctttctcaatctcatccaaatcaaaattccactcaattagatattttaacgggactcttctatttcttagatatttgtattttgtgcttgttttaatattgtttctaatatattcagctattttttcaaatattgtggagttttcatcaaactctattaatacatcagtaatatccaaatatttcagaagatttaatagggagattggctttctttcaactttatagttaaatggcattgcaatgtaatcattttccttaatatcttttgcaggaatccattttagttgattgtctcttaaaaccaataagcaatggtctggagttgcctttagctcataattgttcgaaagagtaattttacttaggtttccattatatctcaatttccagaatttaatggctgtatctatttttattgataaattatctaaatctaatgataaaacatttctttccttagcattaacaatgtcttcaattgtttcaattcttccatcccctaacacaacataggtatctggagttaaacataaccctaactcaaaaagctcttgagctatagacattatttcatcggtgcttaatccaaatctctttgtagcttcctctaacaatgtgtctgttgtgaatggaggtaatggaggaatctccttctcataaactttaacttcaacttcaacctcatccttatcaaactcatcttcccaaatctttccaatatatatgtcattttccaattttagagatagataagggacttttattttatgttcattgtatctctcaataatccatcctaacactggtgtttgaactctaccagctgagaggtagtttttattaaatacctcccaaagcttttgactcaacctaaatccaatccatctatcttctatccttctaactacctgtcctttaactttattttcatctaagctaagttcttctccttttttaaatgattcaactgcctttaatattgccctctttgtaatctcattaaatcctactctgtagatatttctattgaatgggagggcatttatggctatgtcatatcctatcttctctccctctgtatcgatatcggttgctatgaatattgcatcaacctcatcggctatctccctaataatctctatgttctccttagcatccattgcatttactctctctcctttctccattaactgctttatcaactcctccaaatccttttggtcggtaaattgctctccattcacttttttaattgatgtatatattggaatatacaagttattttctattttaaccccatagaaaccctcttttgtaaccaaatcaaatacatgccctccactcgcagttataatcaagtttaaatctccaatacaaacctcatagacatttctgttgtttatctttctaacagagggctttccaaagaagtttgctatagttcttgccttattagggctttctacaaccattaagacagattttagcaaatctgggacttttcctttggctcttccaacttttattttctccctatcttcatcaatctttttaattagctcctctaagtttacctcatctattcttttaaattcactctcatacataaagagcatatactttttgagggcttcaaaaatctctttctcatccaccaatacaatacttgcccctttagtcaaaccaaactctgtcatccttgaagttcttccagatgcttggatataggtttttacatctggaattaacaatagatattcatcatcctccttccttagagagaagttctttatctttaatttctcagttattatctgcctaatttcctcctcagtctttccttctatgttaatatcttcttttaactctcccttctcctttaagctgtttatatactcctttaatctaattttaaacttcggaatgccataaaagatagcatatctaaccctttccggcatgtctaaacctctaaccaagacaccatagtatgatgccactccaatcaaaacatcaatctttccctctctgaaatcatcaaatcccttcttatcctttgaatggattaattttgccttgatattattttctaatagatatttttcaatctcttgggctttctcaactccgtagtcaattgaaacgaacacaattccgccagaaccaaataattttatatactccaaaatcttctctttgctaaattcctcgtcgtagatatcaacaacatccctaagcttattcattccaaatccaatttcaaagtctaaaagctctctgtaaagcttaactctatccccataactctttccagttgcagaagcaattattaaacagccatgctttattttagatatttttttctttaaaatttctctctttttcattgcatcctctatctttccaatctttattaggtagatgattttatatgcctcatttattatctcttcatcaaatcctaacaactttaaagttctgtcaatgtttttagatgcttttaacaatgcatcgacatcatcaacaaatacaaagtcaaatttgcattttggcatgttttttgttagatagttggatgttgttatcaaaacatcataatcgttgttttcaatcctctcctttacctctttcttttcctttgttgagagttctgaatgatatgcaactactcttatatttaagttatttttttctgttaaggaggatattttttcataagtttgcttaaccagtagtgttgttggtagaattatataacatcttttccctttcttagctaagaataggctcataagtattccaaaaaagctctttccaactccagttggtactacgattgaaaaactcttgttctttaaaacccttttagcccacatcttttgaatacttaaaagttcaaatcctaaatcttttacaaattcttcaaattctttaaattcattccaaataatacaataatcttttaaatttttcaaagttttctcttctctaagtttttcacataattttagtttttcaaaaacattttcttcttttaaacatttttcacaaactcctatagctaacctttcactcgttatctctccgttacagttaggacacatctctttatatatcatcggtatcataataacaccaagtcaatgaatatttattagagaatctgatagattataatttaatttttatgttcatttggtttatttgggtttaaaaactttattatttgtttttgtaagaacattaatctatatatttaaatatatagatataatattaaaaaataaaataaaaaaatatggagtagaattaacactggtctccagcaacttctaatattgcctcaactgcctttataaatcttggcatacccgctcctatatacacaactttcataacatcctgaatctcttcaattgttgcccccatttccattaacttttttgtctgtcttttaactgctttttcatcccccaatgttgcaacaaccgctaacaaaaccaatctctgcatcttttcatctaattttttcccactgaaaacctccttctgcaaattggcaacagcctcataaaactctgggcagtttttctttacaacttcaattgtctctgctggaacgaactctgccatactatcctcaatggttgttcattgttgtgtggtgttttaaccacaattatacataattaattttataatataaaaaacatagaaatttaaatccgctaattatatccataagattttatagtggcataaatttgcacagttatattaattaatatataggtgaaaatatggggtttttagaggataaaaagaggacattaatgaatttagaacttgctataagagagggcttagttgatgaggagataattccaatactaaacaaaatcaatgaaatcgataattattacacaacctcaagctgtattggtagggttggaataatggaaattcccaaagataagaatccaaagctatattcaagatggcttgggaagtggcatcactatgcctcttatgatgagttatttaacgctttaaaaaacaaaaaagagggttatatagtttttgttatgaactcccccatattgcatattgcatgtaaagatatagaatcagcaaaaaagatgcttgaattagcaatacactctggattaaaagcctcttccataaaatcaatttcagataaaagagttattgttgaaattttaacaacttataaggtagatacccctataggagaagatggggagatatttgttgataataattacttaaaatttttattggactacagcaactctaaacttaaaagagcaagagaaattttaatgagatgggcaaatagattggatgaactgaaaaaataaaaaatgaaaaatagcgattataatgtgtagtctaatactttcttagcttcttcaatatgctcttttcttattctctcaatatcttcatgtaacgctttaattactctaccaactacaataaatattgttcctgttattaatggaaggttatcaacaactatgtcatccaaaggtaagtctccaggtatttttttcataacatactttttaattgtttcagctactatgttttcctcttcaataacgcttctaaataactccattgagtttaaaaatccttttgttaatgggatgtgcctcatctttatgatttttgcattctcttcctttgcatttctgtgtgctacttcaaataaatctgctaatttcttctcaacaacatccattatgtcctctgcctctgttttatacaaatcgatttcacaagttgttttcattatctttttaagctgtgggtatggaattatcatttctgccattctatcccctctttttaatttttaaaatttttattttatgttctcataacatacctctgcgaaacttatatataaaggtttcctttatagttcccatatttaatttgattattttaatagttaaattttttatttattgattatttcaactatctcaccatctctcaacttaataatctttgaggcatattttgtcaattcctgctcatgtgtaaccataattatagttattcctttttcattcaacccttttaagatactcataacagccattccacttttgctgtccaaatttcctgttggctcatcagcaaatattatttttgggttgtttgctaaagcccttgctatagcaactctttgttgttgccctccactcaattgatgagggtaatgattcaacctatctcctaaaccaaccatctccaaaagcttttttgccctcttccttctataactcttatctctctcatctaacatcattggtaattcaacattttctaaggctgttaatgtttttattaagtggaattgctgaaatataaatccactaatctttctcctaaatatagccctttcattttcactcattgaacttgttcttctccctttataataaacctccccctttgttggagtatctaagagagctaaaatattcaataaggtagatttcccacatccactcggccccattatcattacaaactctccctcttcaatttttaaattaatattttttaaagctatggtttttgcttcccctttaccatagattttccatacatttttagcttctatcaaaattattcccccctcaatgtctctattggatttaacttagccccacttcttgctgggaaataaccgcttatgacaccaactaagaatgaaaatattaaaactccaacaatcaactcccatgaaatccaagcattaaccatcaaataacccattttgtgagccaatgcttcaataacctcagccaataaaatccctaaaactaaaccaacaattccaccaaataaacctaaaaatcctgactcaacaacaaatattgctaaaatatctgttgtctctgctcccaatgcttttaatattccaatatctttcctcctctccaaaatactcatatgcatagtgtttgagattccaacagccccaactaataaagatatagcggcaactccaacaacaaatatagttattactccaaggactgagctaactgtctttgctaactgctcagcagttaaaacagaaaagtcctcatctccaaaagatttttttaaagcttttttaatttcctctgaaactttttctatatcctccccctctttaactgttacggagataaagttatatttcccctcatttccaaataatttttctccaacatcaatatttaatataattgaattatcatcctgctgatttcctatctgctttaaaattccaacaactctgaattttttatctttgatttttattacatctccaacttttatctctctatcaaacaagttatgggcagttccatagccaatgacacaggcatatttgtcattatcctctaaccatctaccctcttcaatatcgtaaccactatccttataaacctctcttaattttgatgggattgcataatagtaggatacaaacttcttttctccattgtattctatctcacaacctccataccaaccatacataactgtatcaacgcctttaacatttttaattgctttaatttctttttttgtaaatagatgtgaaggaggaacgccaaactgtttcataggcaggatggttattttattagaacccattttcatcatctcctcatgtatgtaattttgaacaccatatcctaaagagattaagctaaccattgctaaaactcctattacaatgccaataatcgtcaataaactctgagttcttttttgctttatattcttaaatgcaaaagtaattatatcatcaactttcatagacttccccaaaaaacatctaaagctttatatacaaatataagcttaagctttatatatagatttatgtgggggattatgatgaagaaacttttgataattttaattggatttattttgctatcttcaatatctgccattcaaatagatgctcctcagtatcagccgaatgttattcatcctggggatgatgtggatttgtggattaagataaacaatgataattatgataatgaagttaaaaacatagttgttgaagtaactccacactatccatttgagttgaggcaggttaatccaattaaggggaaagcaacaatcagccatttaaatcctggagaatcagacactgtatatttcaaactacatgttgatgaaaacgccccatcaagagattataggatagacgtaaaagtaagttatgatgaagttgataaagaggatggaaaagaaacaagccaccactatgaaataactaaaatctattatctacatgtttatggaatagcaagctttgaaattaatatagatgatacttcaataattccaggaaaaacaaaaactataaaattagacataaaaaatgtaggaactggaaatgcaaaatatttaaacctttatttaattggaaatgataaaatcaatattttaggaggaagtttaatttttgttggatgtttaaaagcaaataatcaatatatcatccctataaaaatatacgcagttccagaaattgaggatggcatatactcaattaatgcaaacttattttgggttggggaggatggtaagcagtataattcaacaattcctttaaatataagggttgtaaagaagatttatgcaaaccagccgtatatttatttagatgatgtaaaaaataaaggagattatatagagataactattggaattgcaaataggggaactacaaagattaagcattgtgtaatgactttaactgcaaatgggaggaattataccaagtatattggagatttggatgaagatgattatgacacttcaatctttgaaataaaggagtttggggatattccaattaaggtaactgttacatactttgatgactatcacaacccatataacgctacagagacattcaatatacatgtagaaaaagttaaaaaagaggaatcattaagtccaatgtatataattggaggagtaattgttgttataataattatcctatatattagaaaaagaaagagacatcaggagtttgaggaatttgaggaaatttaaatagaactctcgtaatgaataaataatttattggcaatatgtcgatatccatatttttgtaaagttataaatttaatattctaatgtcatatgcaaacacaaaagttctattagatactaaaaactattttttgctacttttataatttttaaagaacaattgaagagtaggataactatgtttattgaacatccattaataaaaccaaaaactttggaggcgaggttgtatcagcagattattgcagcaaatgctttaaagaaaaagacattatgtgttttatcgacaggtttaggtaaaacagctattgctattttagttatagcaggtattttaacaaaaaaggatggaaaggttttaatcttagccccttcaagacctttggttgagcaacactacaacagattaaaacaggttttaaacattgatgaagataaaataatagctttaactggaaaaatccagccaaaaaagagagctgaactctataaaaaagggaaaatctttatagctacaccacaagttatagaaaacgatatcatagctggaagaataaatgtggatgaatttattttattgatagctgatgaagcccaccacacaacaggagaccatgcctatgcatttgtagcaaaaaaatttaaagataaatgtcatattttaggtttaacggcatctccaggttctgatattgataaagtcatggaaatttgtgaaaacttaggaattgagcacgttgaagtgagaactgaagatgatgaggatgtaaaaccatacattgctaaagtaaaacttatcccaattagaattgatttacccaacgaatttaaaagagcgttaaaattaataaatgaagctttaaaggagagattaaaaatattaaaagatgctggagttataaattccattgccgatgtaacaaaaacagaacttattgagctaaataataagctattttcctatgatgaagaagtgaagtatgaacttataaaagtttgttcagaggctttaaaacttatgcatgccaaagaactcttagagagtcaaggaaagagtgtatttttaaactatataaataaattatccatgcaaagaacaaaatcagctaaatctattgttaatgatgaaaaagttagagaggcagttaatttattaatgaaatcagatgtagaacatccaaaattaggtaaagttgttgatatggttaaaaatattttggaaaaaaataaggatgagagaattattatctttgctcaatatagggacactgtagagaagattgttaatctcttaactcaaaatggaattaaagcaataagatttataggacaggcaaataaagaaggaaagggaatgagtcagaaagagcaaatagaagctatagagagatttaaaaaagagggaagtgttttagtttcaacaagcgtttctgaggagggaatagatattccatcggtaaattacatcatattttatgaaccagtgccatcagaaattaggtttattcagaggagaggtagagcgatgaggggagaaggagggaaggtttatgttttaatagctaagggaacagctgatgaagcttattacaggagtgctttatacaaagaaagggagatgaagagattattaaaaaatatgtgttatttgctaaataagaggttacagaagaaatttgaagaaaaatctaaagaggaaataaaggaagagacagaagaaataaaagaaaaagaaattgaatcaaaaactgcagtaaaagaagaaactaaggaggaagaagaaaaaaccaaaaagccagtaacgatattagatttcattaaacagattgaagttaaggaaaggtctaaatcagaagaagataaaataaaacaagagataaaaattccgaaaaagccaataaagattattgtagatgttagagagaagaatatggctaagcttttacataattatgcaaatattgagctaaaaacattagaagtgggagattatgttttaagtgatagggtagttgttgagagaaagacagctgaagactttgtaaattcaataattgataagaggttatttagccaattaaaaaatcttaaaaaagttgaaaaacctctgttaatagttgaaggtgaaaactttagtagattacatgaaaatgcacttaaaggggctattttatcaataattttggattttggcatcccaataatatttacaaaaaatgctgaagaaacagctgatttattaataaagattgctgagaaagagcaaataaaagagaaaagaacagttatggtaaggtatggaaagacagcaatgtccttaaaagaacaacagaaatttattgttgagagtttgccagacgttggtggagcattagctgagaggttgttaaagcactttaaaacagttgaaaatgtatttacagcaaaagaagaggaattaatgaaagttgaaggagtcggaaaagagagagctaaaaagattagagaggttttaacagcagaatatgagggataaaaatgaaactctctattatcttagggacaagacctgaaattataaaactttctcctataattagagctttagaaaaaactaacatagactggcatatcatccacactaatcagcattattctgagaatatggataaaatattctttgaggagttaaatctaccaaatccaaagtataatcttaatattggctctggaactcatggagagcagacaggaaagatgttaatagagatagaaaaagttcttttaaaagaaaaaccggatgttgttgtagttcagggagatacaaacactgttttagcaggagctttagtagcctcaaaattaaagatagatgtagctcatgttgaagcaggattaagaagttttgatagaaacatgccagaggagataaatagagttttgactgaccatataagcagttatctctttgctccaactgaaatagctaagaataatttattaagagagggcattgaagaaaataagatttttgttgtgggaaatacaattgttgatgccaccctacaaaatttaaaaattgctgaaaaaaatgaaaacgttagagctttttttaatagtgttgttattgatgatgattattttttattaaccctacatagggctgaaaatgttgataataaagaaagattaaaaaatattgtagagggaatatttgagataattgagatatacgataaagctattattttctcaatccatccacgaactaaaaaaagattgaaagagtttaatttgtttgataaactaaaaagcaataaaaaaataaaaattattgagccagttggctatttggaatttctaatgctggaaaaaaatgccgagctaattttaacagatagtggaggagttcaagaagaggcatgtatcttaaaagtcccatgtataactttgagagacaatactgagaggccagaaacagttgaagttggagctaatatattagttggtgataacaaagaaaagctaattaaagcggttgaaataatgctcaataaaaagagaaattggaaaaatccatttggaaatgggaaaagtggagaaagaattgtgagaattcttacttatggaaagtattaaaataggactttcgcaggaataaatttttattgaacaatgatacctaaaggcatctattttccaaatttaataatatagactgcgaaagtcctattaaaagataatctttaaatataatgatataattagttaatgccaatgccacaaccatgaaggtgataatatgagtaaacttttattaaaaactccatgcacaacctggacgtttgatagtttaatggcatgtgtttttggtataaaagtttctgatgtcaaagtttattttgatattttaaaaaacggcccttcaaaaataaacgacattgctgagagaattaatagggatagaagtacagttcagagagcagttcaaaatttaatgaatgctggtttagtaaagagaaagcaggtaaatataaaagatggagggtattattatgtttatgaggcaattccatttgaagaaacgaaaaagattataaaaaagactatggaagagtggtgcaacaatatgaaaaaatgggtagaagaattagaattcgaggatgttgttaaagaatatttagagaatattgaggaataactccaaaaagatgattattatgaagctaatattcttaggaactggagcggcagttccatcaaaaaatagaaatcatattggaatagcattcaaatttggaggagaggtttttttatttgattgtggtgaaaatatccagaggcagatgctttttactgaagtatctccaatgaaaattaatcacatatttataactcatttacatggagaccatatattgggcattccaggacttttacagagtatgggattttttggaagagagaaagagcttaaaatcttcggccctgaaggaacaaaggaaattatagagaactcattaaaacttggaacccattatatagaatttccaataaaagtttatgaaatttatacaaaagagccaataaccatctataaagaagaaaattatgagataattgcctatccaactgaacatggcattccatcttacgcttatatatttaaagaaataaaaaaaccacgtttagatattgagaaagctaaaaaacttggagttaaaattggcccagatttaaaaaaactaaaaaatggagaggcagttaaaaatatctatggagagataataaaaccagagtatgttttgttaccaccaaaaaaaggattttgtttagcttacagtggagacactcttccattagaagattttgggaaatatttaaaagagttgggatgtgatgtattaatccatgaagcaacatttgatgattcagccaaagatgctgctaaagagaatatgcattctacaataggagatgccgttaatatagccaaattagcaaatgtaaaggcattaattttaacccatatctcagcaagatatgacaaggaggagtatttcaacttatataaaatgaacgttaaacagtataatgagagctttaaaattattatcagcgaagatttaaaatcttatgatataaaaaaagatttattggggtgaaaaaatgaaaatagcaatattaggaggtactggggaccaaggatttggtttagctttaagattggctaaaaacaataagataatcataggttcaagaaagaaagaaaaagctgaagaagcagctaaaaaggctaaagagatattgaaacagagaggaattgaggcagatattattggtttagagaataaagatgcagcaaaagaaggggatgttgttatcctatctttaccttatgaatacactctatcaacaataaaacaattgaaagaagaattaaaggggaagatagtagtttctattggcgttcctttggcaactgcaataggagataagccaacaaggttgttgtttcccccagatgggtcagttgctgaaatggttcaaaatgtattaaaagagagtaaggtagttagtgctttccaaaacgtttgtcacgctgttttagaagatttagataatccagttgattgcgatatcttagtttgtggaaatgatgaagaagcaaaaaaggtagttattgatttagctaatcaaatagatggagttagggcaattgattgtggtaatttagaaaaatcaagaattatagaggctataacaccattattgattgggttaaatataaaatataaatcaaaaggaactggtataaggattactaatttggagatttaattttaaatttttacggtgattttatggatgataagagctactatgaagaaatagaaagcatattaaggcaaatactacaaccaattgaaaaaatttcattttctacttttattagagtagttagtggttataaaattatccctattgatttatctaaaaaagaagataaagaactaattaacgatttagctaaggcatgtaatgaagttattgaagagattaaaaaaactggtggtgtaaaaactaaggaaggaaaaacaccaaaaagagttaatgaagttggcaatcatattgagcattatgttaaagatgttttaaacaaatacggctatgcaattactccaaaaactaaaaaaggtaagcaaaaatcaacgggttatccggacattgaattttggtataaaggaaagaaagaaagggatggaagggttgtttatatcgaaattaaaacattcaatgannaaaatataaactcatcccatagaactttttatgcttctccttcaaaagatgaagaaggggtaaaaataagatatgatgctccttatttatgcttatcatttaagattgagaagttaggtag

SEQ ID NO: 2 - DNA, 58407 bp, Methanococcus jannaschii
  misc_feature (6485)..(6485): n equals a, t, c, or g
tatactctcgtaatttatatgtgctatttttgaacttagatacctttaggtatcaccatataataaataaatttactttagctctcatcaagtatgtgaatatactgttattaactcatgcataccaggaataaattttaattaatttagatattaatctcattataggtgttaaaaatggattatgagagcaaaaaagttgattatttagttaatcctagcatagaaaaactaatccaacttttaactagtggaattaacaacagtgttataaccctatttacacattgcaaggtttattatgatgggagagcaattggattatcttttaaatattgtcaaaaatgataaaaagtttttagaaactcttaaaaacatgaaaattgacgtagattcagatgaagaacttagtaaaatattttttataataataacattcccattctggttaagatgtcatgatgatatcaaaaatgccctacgtctaatagacaaaattacaaacaagggaagttttactaaagtattggataactcaatgaaggaatatcatgtattctatatttatgatgtggacaaactatctgaccttatagctgaagaattaaaaagattataccttatatgtaaatcagaaggaaaaagttattatgaaaatatatttttcagattggataggaagtcaatattaaaattatttatgaaaatatcccctttcaaacaattagatgttattaaaggaaagctcaaaaatcaattagatttctttgaagaatatttcaataatattgaaaaaattggttatttttcaataagaatggaaaatagtcgttataatgagcatattaaatcacttcatcctaaattaataatatcattgagagtagataaggtgcatatacgtttagaagctcaaatagactactacaatataaataacgaaaatgaagaagcatataagaaaattttagaactgatgaaactcaatttactcacaataggttataaagcagttgaaaaattccttgaggaaatttatgaagaagtttaaccaacttccaatattggtataaaaatactattataacttgcttgcaatttctattgcagtttttaaatcctctattgtcctttgggagaggatataattatccacacaaaattttagattctcttttaatgatttttcttggtctaacaaggataatctttggattattcttttaattacaccctgataataataaacttctgaatttttactactctccatttttaaaataagttttttcaatttgtatattgcttcaattgttggtaattctaaaagttcttcaaaagctgtcataatatcccaccaaaatattctaaagttattcatctgggaatagacacaaattacacttgataatccactttttattcttatcatctggatacacatcgataatattatgctcatcatcagcatactctaatcttgaagtccatgggagtgtttttagagtggaaataagagcattcaaaacattctttctaaaactatcttcacttgaagattttaacaaactttccaaagattttataaattcaaccaactcctcaatctctcccctcataacctcatcaaaagttaattctaaatcgcactttataatccattctccaaaaccaccaacttgaaccttacaatccctcatttaaccacccacaattagaatataatttaagtattctcataagattttgttaaaacttctttccttataatataaatagcatctccatcgttattccaaatagcatatttctaaactactaacaattaatattaggtaatgatacttgaagatgagcgttttaaatatttaccaaaactcataaaaatgataatttcaattatcataattataattatcattatgggattagtatgtttgtggatagagaagaagaactaaaagcattaaatgaaaagttagatagtaacaactttgaattcatagttatttatgggagaagaagaatagggaagacaaagttggcattaaaaagtgtagaaaatagggagcatatttattacttagcagttgagggagataatttaaagcattttaaaagatatgcttcaaaggttgaaccaacaattgaatatgctaaagaggattgggaagcatattttaactttttaaaagataaaatcattatcattgatgagtttccaaacttaattaaagaaaatcctaatgtattatctctattccagagaattgtagatatacatttaaaaaatacaaaaacaaaacttattattcttggctcatcaatatccatgatgggagagaaggtcttaagttataaatctcctctttatgggagaaaaactggagttttgaagattaaaccattgaagtttaagcatttaaaggaatttttcccaaaagctatttgggaagagttggttgaaatttatggttttgctgatggtattccatactatcttgagaaggtaaaacttccattttgggattacttagataaagagattaagagagttgatagttttttgagatatgaggttgatttcttgatgaagtatgagtttgaggagccaacaacttataaaaagattcttgaggcaatagcttttggtaatcacacacttggagagataaagaattacttgggctttaagcattcagatttaacaccatatttaaaaaacttgattgaggttgaatttatagagaggcaaactcctattacagaaagtgtaaaatcaaaaaaggggaggtattacattaaagataattttattgctttttattttaggtatatttttccaaatttatctgcaattgaagaggggatttttgatattgaggagataaaggctgattataatcaatatttaggatttgtctttgaaaaagttgctaaggagtttttaattgagctgaataaaatgaataaattaccatttaagtttttaaagattggaagatggtggcataggggagaagagattgacttaattgctttaaatgataatgataaaaaagctttatttgttgaggttaaatggaaggatttgaaagatagagatgttaaaaagatatatagggatttgtatagaaagtcaaaacttgttggattagatgattatgaaaaatattatgccattgttggaaagaagattgagagtaaagagaatggagattgtttattatttgatttggaggatttctcataaaagttattggggtggaaattatagcattattgattgaagaaggaatcataataataaaagataaaaaagttgcagagaggtttttaaaagatttagaatcatcacaaggaatggattggaaagaaattagagaaagagcagaaagagctaagaaacaacttgaagaggggattgaatgggcaaagaagacgaaattataatcctactaaaaatattattagaagaatatgatgaagaaaaagtaaaagctttattaaactcttttcttgccacaaaaatttagatgttgagaattttttttaaagaattctgcaatattatttgaaaaattaaataagagcagaatatatctaattttcaaaagagggactaatgatattttagcatacttcactctaacaatctctatcttaaaaatagttgatgaaaaaatatcaaaaaagacattaattttgtataggataatttaagtttagaatttaaaatttataaattttataatttaattgttaattgactttgaagtcaattcaccttatcaatttctcatactctttgtcaatggcagttctaagtgcttccatccaattttctgaaagttttatatatctcctcggcctatttgctggagcttccaattttcttgtttttattatacccacttcctccaaataagtaaaaaccctcctccattttctcaacacaagagtaggatcttccttcatcgcctcagccaaggcaatattacacatttccataggaccacacttacaataaccactctcaaaatgcctctcacaagcaaaaagaacttttttaaattcttctgaatgttcaagaactgcaattaatctaaataatgttctaagctctacactcataatcccactcctataaagatgccaaggtataaaagtctattagtgaattgactttaaagtcaattcagcattattatatagtatatccctaattgtttatatttcaaacggaaaaataaatattttgaaaatgaacaatagcatttatttttcacatttttcattagattcatcttttttaattggtttatccaacattttaggtattaaaagtgtaagaacaagaactaacactatatacaccaacattgcagtaagaaacactaacaaccttccctcaaccattctaataacctcccaacaaactaactaattttttattctaaaaaacttatacttagatgccattgtgaattgactttgaaatcaattcactctcaaatttgtattccaacagtgacatgaaaaagaaaataaactatatcattctcccaaaacttccctcccactctggaaaaataagctaaaatccctatttttctctgatatgtattttatcatgaataaaatttgctttttaaattcttttttactgattttcgccttattatgagcatctttcaaataccttggataaccaagtttagagtatggaataagcaaacttataacttcttcaattgattttttgttagttcttggaacttcaagtgctaatattggactgctctcggcaaatctaacataagttttaggaatcatctcaaaaggattttccctgataacttctaaaaatttgaaataatctccaaacacatcacaaatcttgttaatgtgcctcctactcctttttttattataacaatcttccaatttaagagtagtgtatcccctccctctaaatatttgatttagaagtgtagcatcaagtaggatatcaacatttatgttgttttcctttaatttttctgtaataattgaattctcaaaatttttagctatgaatgtacaatcatactctaacaatctatttaaagagtgtagcaattctatatactcaaaatatactccccaacatgcaatttccaatctagaattgagaatatttgctgcaaataactcttccctaatatcttcaacatattcagaatacgtactatcaaacttttgaaaaatctttattgctaagagagtattatcgtaaatattcccatctaaattctccaaaacttcgtcccaaaaattatccaatgattttataaacttccaacccaaatcttcagctaaatctggataaacagttagagggttagtatctccacttaaaagtggtggcattattaaagcccctgacaaagttccatctaaaaggattaaatcaacattcttgctaacaagtgttgcaagcctatactctaaagtcatcattaatcttctaactctatcctcttctttaaaaaatggtagaacacccaattcaaacattcccttttcaatattctttccaatagcataggatgagaggccataaacaataccactacagaattcaaccttccccctactaccatctaccccacataataccccttcaacaccttttggcaactcattccacactacttcatcatttataatatttccaatactgcttatatttttaaactcccaatccacaaaattgtaaattatatccaaatgatttttactaataataaacatttttatcacccctaaacgtaaattaaaggtttttaaatttttaaatttttaagaccatcttctcctcctaaaactccatcatattttttaattttaaccaatgctggaagtgggagtgaagaaccaactactattgcctctccagttgataattgtggtaaatcttgaagtaaatcctctccaacattctcggaactctctaaaatatatttttggtctgttggctctacaattcttaaaattatcttagtattcatttgagataagactgtaggattcaattctttaggcctctgacttactaaacccaatccaactccaaattttcttccttcttttgcaattctattaatccaataaccagacctatccttcaaattctttgctgcaaaaaggtgtgcttcttctataattactaatgttggtttttcaagtgctttaatttcaactatctcatcatggactgatttaattctctcttttaaaactctttttaagaattctcctacaattgttattgcctcctcatcctcaatcttttgaagtgggagaacatttattttatcactcttaatgtcaaacattccctcattctctcccaaaatatttttatttttgttaataaaccatctcaacttttcaataactctatttattgacatttcatcatctttttttacagttttagncctacatcttgttccatcataatactcgatatagattctttttttatcttcagaatttgcaattttatcagcacactctacaagtttttcttcaatttttttcaaatattccaacccagaaatttgttttttattctccttacactcatattttacagtaagtgcagcatatactaaaaatgacttttgaactgaagaattctcaccaataccaagtaattttgccaaatgctcttcaggaaccaatattggattcaattttgcaggtagaatatgagtattcctcattttcacgtattctccatgcggatcaactattacaatattcatttttcccttatccttttcaaacaattcttggactaacacggctatagtatttgattttccagccccagtcattgccaatacagcaaaatgccttgaacaaagctcttttgcatttaatttcacttttgttgaagaccttacctttaaataacctacttcaatactaccatttgaaaatattttagctaacaaatcatccttagtcaaataaacattctgaggcacatttattggatatacgttagattcaatacttccactttcattattaattactcccaaaatttttgcactcgctaaaaatttagaagaattatttaacatttcttcagaatatataacacccctaatcttagctaactcactagcatcttccgatttatcaccaattagagcattaacagaaacaatcttggtaatttttgaaagaagatagtccccatgtgtattttttgtaatgacaaactctcccttcttaatcttgtcaataacctggttctcaattacaaactcaaattcattaacattttttgaagctacaacagtcccaacaactacactgtttataaccatcacccaactgttgtgcgtttgtctgcgttagtatgtatatacaaacttctatatatacttttcgatatctaatagtgcagaataaagtttaatagtacctaaggattctagtattatcatagccataaaacagggtgaatgtatgaaagtgtatgatattagaaaaatacaaaagcgtgttacaaaatccagaggaaaaacctactatacctattatattaacctcccagctgaatggattgaagatgcaaatttaaaagaaggagataaagttgagatatctggagataaagataagctatgtttaaaagtcgtgtatagacaaaaagatgaaaataataaaaaacaataaaataagcatacacatcaacattaaagggtgaaaatatgaatgaattatatgaaatttatgtggaattcagaagatgggtttattgttgaagaacaacataaagaagaaattccatttgaagactggattgtcaacaccgtagaacaacttaaaaatttacaatatactagatatacttttgaagaacttacccccaagacaaaaaatttagaagcatacaacaaattattggaaatcttaaaaaaacatacaaatatggacatagaaaataacgtaaaaagaatttatcattgcattgctgaaaataataactacaaatatgaaattgccttttatatagtaataagtaaaaattggaatgaataaagaaacataaaaaccaattctatgcatatccatttatttaggtgtcaatgtatgattgaaaccatccacatcaaaaattttagaggtattagagagcttaaattggaaaatttgggacagataaatataattgctgggaagaataatgcttcaaaatcaagtatcttagaagctttggcattgtttttaagtgcaaaggaggggttttcattatttataaaaattttaagggagatattactttggagaggatggtatggtgaaaaaagtatttatgatttgttctataaaaattctaaagaacttgaagtaagtgttaagttcttaaatcaagattttgcaaatttaaccctaaaaaattctaatcaaagttttgcaaataaaaatattgcagtagaacttaaatctgataaaaattcttggagtggacgttttgattcacatttaatacatccagattatatatcatcaatattaacctctgcagaggctacacaaagtaattttgaatttataacatccttaacattaataaagtttggatatattgagagcatatactctcaagcctatgagactcaagttttacaggatgctataagattgcttagagaagcatacccagaagttaaaagtctaagccctctccaaaagtataacaagtggataattcatgtttaaactgaatatggagtttatccatactatgtaatgggagaagggtttaaaagtgctttaataattgcattattaacctctatactaaaaaatggttatcttttgatagattcagctgaagcctttcatcacccctcctcacttgaaattacttcacaaatgcttacaaaatctgtaaagaataataacgttcaagtatttttaaccactcacagccttgaattgatagacttcctccttgaacatgccagtaaagaaggtatagagggcagattaatctacatgcgtagagatggggaaaatttaattagcagtatggaatcctttgaaaatgttagggaaatgagagaaactctcggaattgatttaagggggtaatcatgaggattttattacttgagggaattacggatgttgcattcttcattccaatattaaagaaattatatggtttttcagaaattagttgtgatggtattattagagcagaaaaaatgggagatatatcaaaaccaatatgtttagagaatgaagatgttaagttgatagttttccactctggaggaaaatcaaaacaaaaacatgctttgacagcaatgcttacggctattaaaatgggttatttatctaatattaaaatcttgggcattgcaagggatatagaccaagagcatgatgtcaaaaactggacaaagagtataataaaaaatgctggatttgaagttaaagagggtgacaaatttttgattatagaggatttaaacttaaaaatagctgttttgggtattgctaattatgatgaggatgattttaacatcccatcatttgaactaaaaagagaactcgaggcagtaattactgatatggctaaagaaatcagcatcatagaaaaattcaaaaactctttagaatcattaagtaacgatgctgaaagaagattaaagccaaaagacataacgcacgttttagccattgctaaaaattttgacggagactccatgtctggcttatataggaaatttattgaagagcagataaataataaaaataaagtgaactttttattaacactaatatgtattctaccatgcctcaccatcttttaactcttttaaacattttgataaagatttatgacatcttttacatcctttacttcgacaacatcctcctcaatcttaaaaatctgcacaattacctcaatgttcaatatttggacttttattttttgagattcctaaaaaaactctaaggattgtgcttattttaaaaacactaacagggtgaaaataaaaagttgcaactaaaaataaggaatgttttattagaatatttaaaattaaataaacacgttttgagagtttgtaatctaacagtgaattgacttcaaagtcaattcacaaaaaagactctccatttagaattacattataaaagtctctaaaaatagtgatatgataaaataaacttatttaacttttactgttttcttttgcatgtttttgctaagtcggcagtttctttatctatttccaaagctaaattctctaatatcctcaagcaaagtattctgctgcagccctactagcttattcattaaaacctacaaaaatattaccatttttgcatatatgctggataaaagttgctctatcacttaaaagttgcagttttttaattgaaagttttaaagttctgataatagaaattcaaacattaaaaatagtatgttggataaaaccatataaaaactatttttccattgaaatcacaattttttcatgatacacaaaagtttaaatacttttgttttgataaaattttgaaaaaaatatttatactcgaaattttaaagaaataagtatgtataatctcagttaaaaattactgagggtgataaatatgtgttataattttgaaaatgttaaaaaagcttatgaggatcaacttaaaaactatataaaaaatagtttaattcctaacctctcctcacatgcaaataatgaagtagttaaaatttcaatgaaaaaactggctaacttgggttttggatatttagtggatagtacattatcaagtataactggatattataaagttagagattggattgaagaattattaaaagaggaattacagaaatctggagaaaataaatgttgtaatatagtattatgtgattatccagaagagtttgagattagcatgagggaaattccttattatgttaataaggttgtaaaatttaatggtgttattatttcagcatcatatccttgtgttctttctaaaaaacacttatatatatgccctaaatgtggaaggataaaagaagtttattttagtgaattattttgggatgataaggttttttgtgaattttgtggaggaaagatggaatttgcaaatgtgatggattatgaaaattttcaggaattagtagtccaagatttatctgatgagagtgagtattatggtattgaaaaaaacccaatagtttggtactgtggtgcaaaaccatattattttggacatgtgaaaattacgggaattgtaagggaagttcccagaagctcaaaaagtcgtatttatgagttgatagttcaagctataaatgttgaaaaattgggagttgaaaaatctctaataaatttaactgaagaagatgttaaaaatattaagaaagttgcaaagaggggagatattattgacatattggctgatatattgatcccaccactcctctgtgatgatgcgattgttagaaaagccatacttatacagcaaatagccccatatttagaggacataggcaagattaacattctactagtaacggaagttggtattgacaagacagccattctaaagagaattgggaatattcctggaaataattttataaacatagcggcgttgaaggaggaggaattagccacaccttatgataaaagaagtaatatactgggaaaattttatactgtatgtggaggtgtaattccaaggactcttggagtattatgtattgatgattttaacgagaacaataaattaagtacaaaattatctgaagcttttgagaggaatgttcttacaactaataagggttcattttattgcgttcccgctgagtgtagtttcttatgtgcatgctatcctaaaacgaaatttagaaagtttgatcaaaagaaaagtattataaaacagatagggatttcgtcaattttattaaaaaattttgatttaatatttccaattagggatattcccgacaaggatagggatgaagaggtggcaaaatacatttttctaaagtatataaactcagataatgaagaaattgaaggatatgattatgtatttgtagatgttggtggagaaaaaataaaaattgattttgaatttttaaaaaaatatgttgtttactcaagacaaataactccaaaaataactgatgaagtcatagaaaaaatttcaaactggtatgatgaaatgaggaaaaatcattatatcactgcaaaacaattaaatactgttataaaacttagtatagcagtagcaagggcaaaattaaaagagtgtgttgatgaagatgatgtcaaagaggcaatagatataataatgcactatttaaaacaagttgtttataatccaaaaaagggaattattgatgttattttgttgtataaaaacaaaacataaaaagtataggagataaaaattggagatacatttttaatctggaatgccataaagaaagtattgtaaattaacaatgctccagcctctttattcttttcaaatcaaaattataacattctaaagctttattatattctttaaacagagacaaagaagtcatctaatttgtataataatccagtatcaagggaatttttattgatttagagttggtctatttgagtacttttaatattgtcttttgttcttcgttagtaatgttttctaaaatcttttttatcaattctttttcttcattttcaacttcaaaatacatattactaagaatatatacaaaatcttctaagagttttgaatttttttggctaattttgtatatagattttagaataatatctctatgtatatgaatgtttagtaaatcgtgtaaaaaagaaatatcattgtaagctaacacgtaattgcatattacatttataagttggttgtacattgtttttgaaattctcccactgtttaaaagatttattactatatttttaatagtccatgatggatgatctataaaaaaacttaaagctttggctttgatactaaaactatcatcatatatcatttttgcaatttttagctgtataagttctttagattctttgtcaatatcctgcaaactaagatattttctagcaagttcaatatatacaatttttgcttcaaaattatagcctaagtcaatattattacttttttgaagaatgtctaaattatactcttctcgtaaagtttttgtagaaatattgttttttaggcaaatattacagattgtgttaagaatttctagtgataatactttaaaacgttcacgtgttgcaaaagtgttacaaaactttttgtattcctctaaacgataatattcattaattaataactctaggtgctctttttctgcaaagcttgtaaatactctcaatattagaatcctatatgttaaatcttttaaaacatcaacttcaaaaatctcttcattatcaatttttagatattgtgatgtaattattttaattattttctttatggaatattttcttagttctacatccttttctataattctcctaagctctagcattgcttgaactttaagacctctatgggcatattttaaaaacttgaataatgcatctactttcttttctgagttttcttttagtaatataagtcctaaaataactcgttgtatttccacaccatacttatgcacataatgactgttaggatgagttttagatctaattattgtcctatgtggttttataaattctataaaatcatcatatattttatctggaataaagatactctccttcaataaaactctaaaaatttgacgagaatcaatgccaagtttagattttttgagctgggctataaccccatcataatctaacttcacaatcccaccataagtagttccaacttatagtgatttattagtttattttacgaagaatatcgaacttaatataaatgaacgaaactctcccctcccataaagaacgtttaaaacctttcatttatcatcaacaatcgttatttaaatctactattatttagaaaatcagttagaggatacttttaatattccattcaaacattgaaaataatcatttcaaacaattctcccatttatggctgctattacaagcccatattttaatattctgctaacaatattattgataaagttaaactgtatctcaaaaaactaatggtaaaatttgaaaataaagatacaaacttttaaataattttgttttataatttttaattggtggtattatgaaatttttcaacagggagaaagagattaatgagatacttcgaattttaaatagagagccagacgatatttattttatatatggacccttaaacagtggaaaaactactttaataaatcacataataaacaatgaattaaaaaaatccaataaaaaatatgctgtcttttatgttaatttcagagagtatgatatttacatcaatggataattttgttgaggcattgtttgaaatagacgaaaattcgaaagaaaagaagataaaatcatacatagagagttttacaaagggagttaatgatattataaacttatactatgggataaagattccagagccaatattggataagttttttggagaaaaagaaaaggggggattggtttttaagtttattagagatttatttatgagtttgaataagaagggagttcagccagtattcattttagatgaattgcagatgattaaagatattgttatgaatggaggaaagccattattaaaaagcttattccaatttttggtttctttaacaaaggagaggcacatagcacatgttttttgcctaagttcagatagtttgtttattgagtatgtttataatgctggagagttagaaggaagggcgaaatatctattggttgatgattttgataaagaaacttccttaaaatttatggactttttagcagtagaaggaaatattaacttaactaatgaagataaagagttaatttattcttatgttgggggaaaggcaaaggacataaagtatgttattgaagaaagtaagtttaaagacttaagagaggttttggactttatgttaaaagatgaggtttccaaattgagaaaattattggttaagataaaaactaaaaagattgcagaagttgagtatgaaaatgttgttaaagcattaaaattatttaaagacaattatgaaatcaacgaataccttatggacgagaatacaaaagaattcttaattaaaaggaatatcttattcttaaaccccgtagaggagattttaaagccacaaagttatttagtttggaacgcaataaaaagagtattacaaaatataaacgatttttaaaattattggtgggattatgaaattcttcaatagggaaaaagaaattaatgaaattcttttaatcttagaagaagaaccaaataatatttattttatttatggtcctttaaatagtggaaaatcaaccctaataagagaagttataactaatagattagacaagtcaaaatacataccattttttattgattttagaacgagaaatattttaaacgttgataattttattgaatgcttgtttgaagtggatgaaaaatcaaaaatagacgattttagggaatatgccaaatcattagctgatttgttggttaaaggtagtgaagagattagcaaatactacttgggtatgcctattaaagtgccaaaaccattctttgatagaatttttagtaaaagagataaatcagcagatgtctatcaatatattgaatatttatttgctaaattaaatgagaaaggtaaaaagccaattttaatatttgatgaattacagatgattagggagataactttaaacgggaataggttactattgtggagtttattccagttcttagttgccttaactaaagttcaacatctatgccatgttttctgcttaagttctgatagtttgtttattgaatacatctacggaaaagctgaattaaaggggggagttgattatatcttagttgatgattttgataagaaaactgccttaaagtttatggattttttagccaaacaaaagaatattaatctaactaatgaggataaggagctaatttattcttatgttggtggaaaggcaaagtatatttatgatgttattgtcaagttaaaagctgttaaagatttgaaatatattttagagacaaaacttgaagaggagcggaatcacttggaagaattattggagaaggttgaagaagattatgaaggcataaattatgatgaagtcttagaagcattgaaattgtttaaagataattatgaacttccaaaaagtaagataaaaaggaaaattaggatatttttaattaaagagaatattttattcttaaatccacaaaaaggaactttaaagccacaaagttatttggtttggaatgctataaagagaatgttgtaaattaagttatttcaataaaatctactttttcaaagtcaaaatcaagggtagtgagttatgagcattctcatttctaataaacaattcaatcatgggttaaaggatgaatttgctactaaaaaggatttagaattgttagaagagaggattttgagatatgttgataataagttcaatcaattggataaaaaaattgataggactttttatttacttgtcttctttattatactgtgggtatctcgggaggcatttttttatttgatataatccgaacgcctccctcatcgacacccgctcccctttacggggacagaccccctactgccccgatagggacagctaggaagtagccttaaactttaataatacttattattgataaagtattatacgttcatacatataaaaaatgtgagaaaaatgagaaaataaaatatgtaatttaaattgttaagatttaatagtttaaacgtgtgaaaaatgcttgtttttagaacattgtataatgtattatgtaaattatctttggatataattaaaaatgtaagaaaaccattgagatttggtgtaaaagagggatagattgattatattgaaaaaagtttatgttgtaaagtgtatattcataattggtttttactaatggacaaaattatacagtttaaaatttaagtttataaattagtattattctcttttagaatttctgctatatgtttaaagcagtttttcaatatttataatataattaaatcgtatgtttgaagtggactttagccccaaagtccaacaatggttaaaaattttcggacaccatgccaaaacatagagcagatgccactgcagtatatacaatattataatattatattatcaatggcatacagtggcatctccagagaagtgtaaatccaatatgccactgaatatataaaagaaaactataataatccctattttcaaaaaataactgtcattacatagccttgtttggtgaaaacacagaaaaatttgtagtgatgtgttatgggtattataggttttgttaatgcattagctaacgtctttatactacttatattaggtatggtaggtatttttatttttgcatggtttttgttttgcagagaagatgaagagacaattagaaaaataaaagaagatgattggtgaaagtgtgaagttattaaagatttttctatttgttttgttttgtagttagagtagttctaagttgtggttgtattggagatgaatgcactccacacccataggcactataagcgcgttgaaaagatgaatacagtttgttcatggaatgtgataaaattcattaaaaatgagtttaaaacaattcttcacaattctttaggaggatactatgaggttggtaaactctttattatagcagtggcaacaaaacagaaacaaccctaactcttttattaagaataccaacaccaccaaaacatcacccaaagcacccttatgaataaaatgaacatcacacgagaatccactcccctaacactctttttacccaacaccttaacaacattcatgaaacaccacacacaaacaaatcctaaaatcaaaacatgccactgtataaaactattgataataattaataatataaaaattatcaaacttaatactaccaaaacaaataaaataaattcccaccacaaaacaaaacaaacaaatattataatcaccaaacaatataaaaacaataatattatgtaaattcccattagggaaaaggtgaaaacatgctcaaaaaactatttggaaaagacgatgaaaaaacagacgaacgaattaaaaaattagaaaacagaatagaaaaaatagaattagagttaaaaaccataaaaaacacaagttcatacccacaaattataagaatagaaaaagaactccaacaaataataaaaacagacattgacaaactaacaaccctatacatcaaactccaacccaaacccaacaccatagaacaaacaaaaaatcatacaaatactaaaacacgaacaacccctacaatcatcaaaaatagtagaaaaactaaaaccaaacataaaatcaaaaggaacaatctaccaagccctaaaacaactacaaaaagagaaaaaaataacaaaagccacagtcaaagaaaatggtaaaagaaaagtatactacaaactcacagatgaaaacactgatataacatagaaaacatccctaatcctaattgttaaaaacattaattatcaagggaggttgccacactttttaaaaagtgtggcaacctcccaaatattcctataagaaacaaaatttaccataaagtaataaaaaccccataaacttattttcctataggataaatgccattgactattagaaaaacaacactcttttatgccactgctaacacacaataaatttccacattctatacacaataaagtgtttttaaccgtaattttcaacattggactaaccactctaacagaaatgtgaaataccccacacacttccaagacatgaaacgccccttatttttcaatttttcaattgtatttactaacattcacaaaagaggaacagccaatttttaaaaattggctgttcctccaacaccataaaaatgcagacaacaaaccaaaaacccattaagcaacatactgagattgaattattacaacctataaaaatagtgttatatgttcatacatataaaaaacatgagaaaaatgagaaaataaaagatgtaatttaaattattgtaatttttctatttttgtgagtaaattgtgtttagtttaagaagtattccccacttattatgtaagtggattatttactccactaaaaatgtaataaaaccattgagatttagtgtaaaagatgaatagattgattatattaaaaaaagtttatgttataaagtgtaccttgataatcagttttcaccaatagacaaaattatacagtttaaaatttaagtttataaattagtattattgaaaactaaataataaattatgtgtttaaatatttattgtttttagtatttgttcaaattctgtgtatttgattttgactgggaataatagtacgtttccaaaaaagttatttttatatttcaatcctttaatgttatataccatgctaatgtattctaagattgtatcaacaatgctatcatttaagtctcccaatacaattccataataagttttccagtaatcagcaatatcatcttcttttaaaggattaaaaagtgatttacccatattgaattgactttgaagtcaattcacgattatggaaatagtgaaacagtgttagaataaaacaaaaagggtaaataaacttatttcttcaaagctagttttacgtcttcgacttttactgtttttctctttgccatgttttgccaagtcaacagcttctttagctatttccaaagctaaatcttctatagcctcagcaaagtattccgctgcagccctactaactctctcagccccatccttttttaatatccttacaaacggtgcaactgaagctcagccataacaccacccaaaaaaacttatactcaaaaattatcaattaaaacctacaaaaatattactatttttgtacatatacacctcccaatattataatattctacaatacaataattacataataccacaatacaataatccaaaatcatgctaaagaaaaatccaataaaacccaaaagaataacatgattacataataaaacaatacaacaattaattaataacataataaaaataaaaacttgttaaaattataatattttaaactaactaaaaagaaaataaaaatataaaaattaaaagagggggagagcccgagaggggaaggggagaaaatgagaaaagtggaaatactataaatagaatatgaaactgtcagtttaacttttatcaataatataggtaaaaaatagtaaaatatgaggctcacgatagtggctataaaggagagaatcgtggaaaagaagtattcagattaagaaattgcgtagaaatccttcttattgcttaaacgaagaattaaagcattctataacagatttcttaataatagtagattcaatacggtaattagctggataaaaagcttcatgatgttctataattggatgcaattgttaacttgacaacctctaatagaataaccctaccatcaagtattttaccagtattttttagattttaaaggtaaaagatttctttggtgttaaaatagattaggagtatagaaaagttgattatttggttaatccgtaggtgatttttatgtttcatagtggagctatggagttgcttaaaattgcagagaagttgtatgacaaagattcagagaaagctgttgaagtatatgataaagcaattaaaaaggctgaaaggatttatgatgattatgctaaagccgttattttgtccaatatagccaaatctctatatagcagaggtttaactaacaaggttattgaagtatacaataaagccataaaaatagcagaggagagtagtaaaagagacgtaatactatcaaaaattattgaaaatttatgtagtaataggttgatagataaagcgttggaggttgtgaataagatatctgatgattcttctaaggctatagcattatctgagatagcaaaagctcaatacaatataggaatgcatgatgaagcccttaagaattatgataaggcaatttttataactgagggtgtttttgatgatgagattaaatcttcaatactgtttgaaatatccagagatttttataactatggactagtagataaagcatttgaagttattggaaagataccttactctaagtataggttcaggttgttagataaaatggcagaagatttgcataagaatattaaatatatacatggagagtaaagagtttgatgatgataaaattaagataatatcaatgactccaaagagtgaaaaatctgataagatagtaatgcagattgtggaggagtttattaatagttttccagatgatagatataagtttagagtgttgttgaaagttgcagagctgatttgtaagaatggcttatgtaatgaagcatttttaatacttgacaagattccagattcctattataaatcttcagcactatataaaatggcagacatattatatagaaataaggaacatgatagattaatacagattgcagaaaagatacctgatgactataaaaaatcagaagtcttattaaaggttgtagagctattatgcgaaagtggaaaatatgatgaggcaataaacatagctgaaaaaatacctgacaattattataaatcagaagcattatttaaaatagcagaaaccctaagcaacaaaggatattacgacaaagcagttgaaattgctgaaaaaattccagacaatttttagaagaaaaattatatccaaggaatgttaataattcatcttctattaattctagtggttattttcaatatattgcacacataggagtttatgaatatgaaacaggtaattacctcgataccatattattcgtaagattttaataaaatagtaaatttgatactgttgttagctggattaaatacttcatgatactctaaatgaggtgaagttactaacttgacgatcttttttattaatatgcaagcattatattataatatttgtagatttttgtatttagtttcagaaaaatttttaagagacccaacacattttcctaaaaaagaaagatttatatacccaacatcgttccaaaatttctttagaaattagcattggcgatagatatgccatacgacattaaatgtggagaggcatataacatttcataccaattgtagaaaagaatagtatattaatttctaatcgtactcgtattttaaataacttgatcaaaatgtgtaatttgaatataaaaccaaaaactgaagatgattataaacgattcctatatgattactcaaatcaatgtggagtagatttcagaaaagtagatgtgggaataaaatttttcaaaaatatgctggatataaagtaaaagattacggcagttcttggaaatattcagagttagataatcctaactacacaatacaagatgcgtgcagagatttactcaaaaataatggagtgaagtacctaattaacaacagggcattaaaggtatctttgaaataacattatttgatgtgattaaaaagaattaagattgtattttaggtggcagtatgggaaaatgtaggcataatggagaggttagtatttttggcgtaagaccagcaagttttccttactttccatttaatttaatggataggattggagggtttgtaatattggatgagttgtggttaaggaggtggtgtgagattatagaatatccgatgaaaattccaactttatacgtgccaattgaggattatggtattcctacagttgaggatatggatttgattgttgattttataaagtatcatgtttctaatgggagagaagtcgttgtctcttgtatcggtggacatggaagaactggaactgttttggctatttgggctggtttaaatggcgttgaaaatccaatagaatatgttagagaatgttactgtgagtgtgcggttgagacagaagaacaagaggagtttgtaatggagtatttgaaaaagagattatgaattaaaagaagattatatctaagagttcatcatatatttctatttcacctttaaggatgaggtcgataagttcatcttcactaacgataatgattttaccgttaatattgatttcaaattgattatttccaatgtatcttatgttcgtgttgttgatagcttttcttaatcttttaattaagtctttacatgcttcttgtattgtgtatttacataacctcctattgtaatactttgcaactttgctgttaaagaaccacatacccatttctacatatctttggtctaatttgcatttctttgaatattcatagaggaatattttatatggataaagagttttaaaatcattgctatctatttttgcatttttacgaagtttttgaatacatctacattctgtataatcaaatttctctaaaacttcattaatgtcaaaattataatttaatttacatttacatttaactaattcctcaatgacttttttaactactctatcaataggcttgtataacaaatccctgcaatctccatataacatcaaattgtgaataattgaaatatctctaaggaatagacaagctattttatctccaactcctctaattctaattaaaaagttgtatgcgtcgtagatatttccatttcttaataaattaagtagataagacactaatgaagctgttatttgagtattactaataatgtataataaaccacatttatttgtggtagttgaatttatgttacaactcggatttatattgtatcttgggtctaaagtgtcacttgtatagaagcccaatcctaacattcttagattattttcatagcaattgcatatattactaatccaagtattgttatgtaaattgaaatttctatctatgcaaactgccccaataaatccatggattcttactcttatggagctataactactcccaaaaggtctcatataagcataatttgaaataaacaattgcaatgattcacttaaatcatttaaatgatttgggaatattatctcccaaaatgcttttaattctagtgcttcatgtaaccttccgacatcttcaaagaatttaaaccatgcacagatacaatctttattagcatattctccagaacaataattttttcttaatactttaagtatatcttcaacttctttttctatattttttctctctttaataactgggataaagaactttttaataatatctcttgctaatggacagtttctaatcctgttgataaattgctgaactaccatccccactcctctccacatctttcaaatataaatgtactgcagttcttaaatataaattaatataaattttataaatatttacactaaaagctctgctaatattttaacctctattgagtttctattttccttaacagaaatcaaatccatactaagtgtttattattagcaacaattcctataggtgtagtttctcttcttcaaatttttggtaatatatttttaattacattgaaatcaaatatatgtacatactccttttccacatcttaatattacaatattatcaattctcgaattttccttcctgtttttaaatcgatataaatatgacgtcttccattacattttaacatcacacgattatcttttatagatattgactctatatcccactcagttttgaactcccaaattttatctccagtttttagattaatggcagagatacatcttcttccacattctaatactgcaataccacctctaatagataaacttcttaattctaacatcttaacaccattatctctactgatgttgaattaatttttgaatcataatacttgtttgattttttgtattattgagtagtttttaattatattgaaatcaagggcataaacatgtcctcttttacatcctgatattacaatattgtctttgatggacaaatctaacactgcactttctgttttaaacttccatatttcctcaccagtgttaatatcaagagcataaagataattatcacatcctaataatacagcatcatttttaatagacaaaccattcacatccccatctgtcttaaatgcccataaattctcccctgcattaatatcaagagcatagacacattctcgattacatcccaatattacaatatcatctttaatagataatcttaatacagaccctactaccttaaatctttccatcttctctcctgtattaatatcaagaagataaacataacctcccctacatcccaacaatacattatcctttttaatagataaactctttacctctccttctgccttaaacctccatagttctctaccagtgtcaatatcaagagcgtaaagataattatcacatccaaatagcaaaatgtcattttttatggataaattccgtatggattttcctgattttgctttaaactcccataacatatttcctgcattaatatcaagggcaagtatatatccttttttacatcccaacacaacaatatcgtctttaatagataaactccttacatcatgctttatcttagacctccatatttctcttcctgtattaatatcaagagcataagcatacccttcctccaatatttttccatttttcaacatgacaatgctctcaaatatatttccacatcctaatacaacaatatcatctttaatagacaaaccccatactgtatcctctgccttgaattcccataatttcttaccagttttaatatcaatggcataaacatgtcccgaaacacatcctaatattacaatatcacctttaatagataataaccttacacccccctctgccctaaactcccacaataactcatctactcttttaatccctaaaatatccaatataaacttaccaacattaattgctaactcatcatttgagttatttaccaattcaattaacttattcatataataattaaatacagccctattttcattgaaaatgtttttaaatctgctgtatatttctttatagtttgatgtgtttaaattatctatctcttgttttaggattttgtcaattttttctggcctcatgtcatctacattatctcctttaaattttgtaattgttaatacttctgtaaatctttctttgtatcgtatgttaaattcatcttcaaactctacaacaatatctatcggtagttttcctttaacttttggatttataaaaaggttaatgacttttgtgtctcttcctctaatttttatcggctctatgtctttaaataaaatatcttcttcgtttattattgaaattttcgatattgttatatcttttaatgatttgtttgttatttgtattggtagttcatcccattcattcaaattaagtgatttttttaatagggttaaatctatctttactatttctttcattatattagttagttgtggcctaactctttgtatttttgaatacaggttagtatcaagggcatagacacacccccacatgtctgccaatatagtaacatccccacttatcaataaatcacttacatgccactctccaccaaactctaatattttctcacctgttttaatatcaaggacataaaaatattcacacccatattcatcctcacatctcaatattattttatcatctttgatagataactcccatacacaccactctgcttcaaactcccacaatttacctcctgtcctaacatcaatagcataaatgtatttatccccatcacccaatataacaatattatctttgagagaaaaaccccacatacgctctcctaccttggactcccatattttatccccagtcataacatcaagaacgcaaacatgcccacctctatattccaacattacaatattatctttgatgaataaactatctacattgtgctctactttatattcccatattttattccctgtcttaatatcaagggcaaaaagatggttactacaccctaatattataatattatctttgatatctttgatggacaaatcccatacactcccccctgccttaaactcccatattatgctatcttttaaaatacataacataaacttatcaatttcaagtgataactcattatcatctaaatttttcattaactcaattaatttatccacgtaataattaaatatatctctatttttgctaaaaacatttttaaatttgtcatatatttctttatagtttgatacgtttaaattatctatctcttgtctaatgttttcaactccattgattttattttctacaaaaaccattctcatcaccaaaaaaacttttatttatttcaaaatttttctaataacacaccattcaattatcgaaattagattaataattccattacaagtgtctctaacacttcaccatatttttattataatttcattataccttaatagcatattaaattcaataacccaactttaattttgcacttattaagatttgtaacattatcaatgccccctaccataattccataatgagtttttggaggtttcactaaaagaagtaatctacagcattctttaattatatgtctgaattgactttaaagtccattcatcccttaacattccttataaagaaatactctataaaagtttattattacattattgcattaaacagttaaacatataaccaataatttaaatatgaaataatgtaatgccataatactgtaataaaataatagaatatctaatggtgagagtttatggttgtaatttcaattgcaaatcaaaaagggggtgttggaaaaacaacaatagcattaaacctatcatttacacttgcagaaaaggggtatgatactttagtaatcgatttagacccacaattcaacttatcctttggaattttgggaatgaaattattagattatgctgataaaaatattggaatactattatcaaaaaattctgttaagaagaaagaaattgaagagtctattataaaaattaatgataagttagatttaatcccctcccacttgcagctttctgctgtagaaaaaatgttagttaatgcttatgcaagggaaatgaagttgaaaaatatcattaaccaaatcaaagaaaattatgactacataataattgataatgccccatcattaggactatttttaataaattcattagtggcatctgattatattatcatcccatgtgagccaagttattttagtattgcaggagttcaactaatgttagatactgttgaggaaataaaagaatcaaacttgaatccaaaacttaaagttttagggtttattttcaacaagtactctaaacaatcaaaaattccacaaaagaggttagaacagttaaaacaactctatcctaacattccagtaattggagtaattccaagaactattactgttgaaaaggcagaacgtgagggaaaacctgtgtttaaatttgatgctaataatcctgcaagtgttgcattctcagaacttgctgagtgggtgatagaaaatgtcaaatgatgatttgaatgcattaaaaaaattaaaagaaattagttctgggacagtaaaacagataacttcactaccaaaaaaagaaccacaagaagaaaaaatgtcaaaaactctaaggataaaaaacactactcatgaaaaaattattgaaatgtatgggaaaaaagttggtagccaaggagaagttgtagataagggtgttgcagtcctctatgcattatggaaaatacttccagaagaacaatttaaaagggttgttaaactggctgaagaagataggtttgaagaatttgctgataggttgggtattgaaataaaagaagaataaataattattgcattgcatttataatctcctttatagcatgccattcgataatagatgtcggtttgattattccatttatcacatcataaaacaatatttcattctcaattaggaattttaaatatttcatttcctcttttttaacttccttatcataggagatttttatcttgtccttgaatttagataaaacattataaagcccctcctcatctaaatcggttgtatctataaggtattttagcccatctttttcaacattaatccactgttttatagtttgttcaacagataaacctaacttcttattatttatcagttgagaaatctcataaggcaatgataaatagtctaaagcataattaatctcttcttcgctaaaaccttcttcttttaaaatattccttatagttccttttcttaaccagtcaattaaataatactcagaggcattttttaatgttgaattcctatagatttcatcaataaataatgtatcagaagttaagcatataacatggcataaatgttccattttagttagagagacgaataagttaaacaattcgtttaataatgactttcctccattaaaataaatattcttcaacttttgtaactcatcaattattaaaactggcttttttccttcttcaacaactgcgttaatactctcatttatcttagcaaagacatcatttaggcataagttattaaagtcaaaattctcttcaattccaaacttacaaactcccaagttaagttctaacttatttaatagatattttttatccgacttttcaaaaaatactcttaaaaactcatcccttgttggtgttgcatattttcttaaattataatagaaaaacactatattactgttttctaactccttaataactctcctcattaccgtagatttaccagatgatttaggaccataaacaaaaaggatagaattaggttctaactgacagtaggtttttagatagttgagttctttctctctatcatagaatttcataatttcacccaaataaactctttattttaattaaaaatattattttagagtatttaaaagttgaacatgccatattacattagctgtgaatctaaagttgaaaattaacctttactgtctttatgacatcataaccacactacctattgtattattttattacatcataatttaattgcattataacataataacattattccataattctttatacaataattatttaacaatggcattaaacaattacttaaaaatttaaatacacaaaacaacattgcaatattgcaataataaaataattcattaactaaaaataataaagtggtgaattgactttgaagtcaattcacagttatagataaataatgacctaaagcttctccaaatccaatggaacatattttacaatataagccttatttacaataacaacatctccctttccaacatcaaccaagacagtataagggtccttacaacagcatttgccctccaacacttcaccattagccaaatgcaacctaaccttatgattatggcaaaagaataaaacataatcttttctctcttgagtactaacacacgtttccctaaccctctttggctgctttttacctttgccctgttttttctggccagtttgttttttaccattatttttagatttttgactttccaactttttaagctctttttcaatctcttctaaatgcttacttttaacgtgtttcctaacaaccttagcatcagcattagtataatcacaaaaaggacatttataaaaaccaatatcattcttttgaagctctaacttctcaacatactcatcaacattcacaatctcacctagaatatccaaaatttgaaaaatagcaaaatgtcaaatgcaatgtattcccccatactatcaatatgtaaagtaatccatatttaaaactatcctaagcctagtaacaaacacaaagaatgcaaataaaaagaaaagatgaaaaatgtgacatttagcacattaaatgccattgttataaaataaacaaagacaaaactttcctccctagcaattttgagttaagagagacaaccaacctgcagcaatttttgagaattttagtaaagggaattatcccttacataatacacgcaaaaagtgcaatcttgttgcggaaattcattcttacttttaaatttattatctatttgtttgcataagatttaaatgtattgttatatctattaatttttgctaatgtttattaataaaatatttaaatatattgattaatattataaaactcttaaaattcatcatcacttttttgtattgttgttttaattaggtaatccgcagcaatccaggttttggctcgtatattacccccaactttttcaacttttctaatgctttatagaatacttcttcaacaaacttcaatttttcaacaattagttcatataattccatttctaatatttcccctccattttcttcaattttcttttcaataactttttcacacttttcaacactgttagagttaatattttgttttataatctcatatagcgttttaaactctttgttaagttcttttatttcaactactgcattttcccccagtttttttactcctctaattacacaattaaatattgctcttatcaatcttctaacttcatccaaggttagagtgaatccacattcttcttttataacctctattaattctctaattttgaatttttgtctttcaatggcaaaatctctaacttttattaacacttttgcaactaatgaccttaaccctaactttctcctatctaatctctcatcatcttctcctactacaatattccatactgctcttataatcctttgaatcttaccccattttgatggagggcataagaatgtttttagaattagctcttctataattcttgccaatgttgagagtttatccttatgttcctctaacaatttcaaatcaatatggtaaattttctttgtttttctatcttcattttcattaatttctttaacaattttcttatactcgttaatttcttctaagcattttttaatagtattttcatctaagttcgattttttatcatcatcttttcctttattcaacattaggttatacacttctataacttctggaatattataaacatcttttaacacgtttatactcctgttaatcctttttgagtgtttttttattaattgtggagtgtattcatccctacaatctttaaatttcttataattattatattccaaggcatttttgatttcattcactccatattctttaaatgcaataattatatgttttgcactaactttttcaagatattcgagataattatattttaagaacttatccagcttactttcttttaactcttttattgttttaattgcaaactcatagccagtagttttttctaaatactcttttagtaatttataatctcttgtaatatgggcctctaatagactattataaatgtgtgctatttcatcttcatctaaaacccaatccttcttttcctcatcataatatattgcattttgaatttgagaaatcaacactttcttataatttttatccaattcttttaaaacttcaatatccgtttctaaatactcttttaatagtttataattttccttaaacatttcaatcattgcattataatcaataatcattggctcttcttctctttctttaaaaggtgctgtgacaattaactctcccccaccattcctacatctggcaataaactgtctaatggtggtagcactcttacaatacaatgcccataccaaatcaacatgatttttaatattaactccctcagaaatgactcttgtggctaaaattaacccctcttctggtactttttcttcattaataatcattttacttgccttgtcaattccaacagtctctcttgttataacgtaaattggcttgttaaaaccatacaattctaaagtatattttatattctcaatcattttcttattatcaactaaaactacagcattttttatccatccctgtctaaacattagtaggatgtattcacaaaactctccaataatattttttgcaatatggatagaacatctttcaaataattttttctcatctttaaattccacttctataactggatagttattcaaattaattaactctggagttgcagttagtaagacacaacctccagccctgtctatacacttttttacccctgttattgccctttttctaaactctttttggattactaaatcatgtgcttcatctattgccaatagaatatcctcttcattagcaacttgaattttctcccctttataagtgtcataacataaatcattaagcatattttcaacttggtcgtaggtcccaatggtcaaataatgaatagtattcttatccaattttttcccatcttcataatacattggaactactactccatcagcgtgtaatcctgcccctacttgtaaaacttgtattttatatgggaatgccactgctatagcatgttttttaaatacctctttaatttctcttgtatttcttgttagagtataagttttcccccttccagtgtctgctttaagaaatactggaactccttgttcaatagataattggtatgcttttattatagcctcttttggtaagtatccttctgcttctatctttattgtttctctatcgagtagttcattcattatctctctaacagtcctataagtggatggctttggattaatattgtgtaattttaaaaattctattattttatccctaaattctttaatcatccataatcctgctaatgcaataaatctcatatttggatcgtggaaatctaccattactgcattatatccctcattaatgtaaatagaacagtcaggatttttcccatcatcaaagaataaactccataagtctaatctggttccatttttaccatatttataatcaattcccaagtaggagaggagtttttcaatccatcttttacccaattttttagttaatttatcttgtatagtatataaccatttgtaaattcttttatttatatcttgcaatatagttttattaagatttggtttttttattaatctattaattgttgtggtaatgttgtttaatcctcgcttattgtataattcttctcttttttcattgaataatacttcaaattctttataattttcaataattccaaacttctcatacaatattattggagttaacaatttttcaatatcttcttcatctgtcaactgggctattgtaacacatggtcttggactaccatatttttccttataattgtaagttcctaccagcctatcaactcttgccaaatcatacattgcaatatctgcccctaaatcttcagcaatcattcttagtagtattaattcttcttctaaaataggtctttcaggatataatatgaatcttaatcctcccccagtaaatgccactttatgtggaagtatatccttctctacgaattttgataaatatttaatcaatttttccataatttcttcttctgtaggcattttgtttgtcttccactcttcaacgtcaaaatcaaatgcaatataactccaagcagtggcagctcccgcatcccctcttttttcctttcttggggcaattccgacataaaccccatctaatcttcttttcttttgttttttaatatactcatactgtttttttattaattttatgatttcttcagttttttctaaaatattatcaacgtgtaaatctgaaatatctatgaaaaattgttttttacccttaaattttcctaaaaatctaatttctaaatacttaaactgttttactaattttttcaaaattttttctaaatgagtttctccaagatatactgaaaattcttctttatgtttgacaatcaaaaatagcaactgtgcaatgtgtaattttaaatcagattctaaaatatcatctgagatattgtaaattccactaacatttatttgatacttatcaaaaatagcttttacagtttgatcatcccaataccgcaaactttttatactattagatagtatattattcattggtcactcaccttactgtgggtagtatatattcattggtcacatctcttggtcatacacctcgaccatgcctacactaaatactccctaatgttgcaataccttaacatataatgcaatacaatactgagctcttttgatacaatctatgtaatttaaagagtataagaaacattttcagggggcgaccatttctatattattttttgaagtatataaacttttagttattttttgaatttgtatatttggatttatatcatataactttttctgaaaatttttcctgacatatctattaggtagttagtatatatatatttttcggatttttgcatgtttttacactttatcttctaattttataactaaaagtttatatttttcaaataaaaaggtttatatactatgaaatcatagtattgcttgattacaaaattatttttttgataataatgcctattttttcttaattcgttgtgtggttgataaaattgttagcagcatttatgttttatattttaaaaagaaaagcattaaatctacatttattgttattatcttattttttgtgtcttttttatcttctgtaaactcttataaatctcttatatagtattataattattctataaaaatatgtggattaagttgggtaagaaaaatgtgcgaaataggggctaaaataatattaaaacattaatgtcttttgtctagtgttacatttttagttacgtctttaaccacttttattagtacagtgaattggcgttgaattcaatttacaaaagagacattctatatatataatttacttataattatattcaaaaatagtgttataataaacaaatggataaaatgggcttatttctttaaagctaattttatatcttcaacttttactgtttttctctttgcgtgcttagctaaatcaactgcttccttagcaatttctaatgcaatttcttcaaatgcctctgctaagtattctgctgcagccctactaactctttcagctccaacttttttcaagattctctcaaatggtgcaactggaagctcagtcacaacactacctctttgtatatgtagagtgtagaagctctaataacctacaaagtgggagttcaaatttgctaaactttaagctcccttaatggaaactcgaaactaaaataagtaaaaccataatacaataatacaatcattcaataatatcataaaatcataatttagtaatgcaataatccaataactccacaataacataataaaataactttgagtttccactaaaagaaattcaaaggtggggttaataaatttcttatatgaattgacttcaaagtcaattcacaaaaaagaaatgtcacccatcacatcataaacacatccaccgacatactaatcaaaatttaattattgaattattaaattaaacaataacataataacataattattacattatgttattatttaaaataaccataaaactccagatagtattattgggtcctcgtaaaaatatagtcgttcaattgaaccataatattgctaatattggtcattctactgaaccaatatataaatgttttttatcattagttagggttcaaattggcaacttcaccttatttatatagtatttcatgaaaatgtagtaattttcaaactactatttgaattaactttaaaatcagttaaaagaaatattttattcttaatcctattgagggaactttaaaaccacaaagttatttggtttggaatgcaataaaaagagtactgtaaattattctttaattatctcaataaaatctactttttcaaagtcagaatcaaaggtagctaatttatttatcctataatatttacaagtggctattatgattgcatcgtttgttaaaaggttgtattttttacctatttcaggagctaattttaaaacttcccaatttgtatctaatatttttaagtagttcattttaatcattttatcaattttttctctaacttcttcatatacccaagaatatctatttaaattcttttttaaatcataaactcctctaattccatcttctaatgctatatgaaatgtcactttaaacattgtttcagaaaagactattggatttatgcataacataaaaccatcatttattagtttagataataatttatgagctttttcatctccaataaataatccaaccatgactgaagaatcaataaaaacattagaaggactcataatatgcctcttttaattttttataatcgatatctttacacttttttattatcatagattttaaaaactcttctacatcatcattaacaattttaatttttaatctctttttaccctttatttttaatggttttaatggttttaaaactccatcttcgtaaataacttcaataatttctgacatataaatcaccagaggcctttatttttctatttttctaaggtaatatttaaaccttctttcgaagtgtatattattgttttttgagaattgagaaaagtttaatttgacagtttcttaaatgatagacagagagtatatgataattatatatttaactttttattattttatactcttcgtttatactcccttatcttggtttctgaacgtgcagcatttttaggctgccacctgaattgactttaaagtcaatgcactctctttctaacgatgaatatataacatataaacagagaaataatactactaaaacatctatatttaaaggtggtgcttacatttttcttatttttctccccctccctctcgggctctcccctccccctctttttaatttttctattttaaaatttaaattaatataattattaatttgacaatttgacaagtttttttattttttattattgttttattttgattgtattttttgtttttgtttgtttttatcctatttttttgcttgttttgttttcttttgttttttgtttgattgtattttgcatcggtattttgtattttctttagtaggagtttgtattatgtttttattgtattgttggattatgttgtcatgttattattgtattatttagttattgtattataatttgtattttgtatttccttaatggagagaggttatttattttattgttttattgtattattttattatgttattaattaatagttgtattcttttattatgcaattatgttattcttatggtgttgttgtgtttgaatttcttttagtggaaatttgaattatgttattgttgtattatgttattgcagtgttatttaattgttgtattattttactttgtaattatgttgttctcgtgagtttgtttttttaggttttaatagagtgtgttcaaaaataggttgtaagatatggttagaatagtctttgctaaattaaaaataattaggtggtagaaagatgagggtttatttttctgattagtctaaggtagtttgccaactttttatagctccaatttcttctttacatgattctttaaattttcttgccattcttttatctttaatcactttaattctccattttcttgatactttcttaagatatccttttaaatttctattactaaataactttaatgtttcttcaattcgtttactgactatgtttttataatccttatagaaataatcaattatggagatacttgtgcttctgtataatgcatccattatagtccctacagtaaactctttttcaacaagtgagtccatatttatagaaatattgagagcatcaattaacttaagaacatttgcatttagaggtttattttctggtaatattacaatatctttatctactcttaataatttattttctttgtctattatacatttcttcttacaaagtttttgtataatgttttcaatttctttaaaatcatcttcttttaaactttctaatgagtattcaccttttgggagaataatctttttactaaataccatccccacttctggctcatcgtgtccagataatgccatagatacgagttctctaagtataagaattttaaataaacttccctctttgtcattctcagcatcgcaaatcagtaaatcataggaaggtttctctttttctccccaagttattggaaatattttatttagcttttgattttcataattaccacgttcgagtgaaatttctccaggtgaaacttttaaaatttgaatgtcttctgtatcttttaaaacaggatgtgtagttaagtcatcaaatgacatgtaacttacatcagacttatataatctaggattttttgtgacagaaatgtatcctttgtttataataacatgtagattctcttttaatttcagatatttttctaattgctcttttttgatacttttagatttgcattcaaaaataagaacatgtgtatcattatcattaacaagtataacatctggagttatttctgcaggattgccatttttagtataatatattccatcaagaacgattcttacaccaagagtactaccttttttgggtcgatatcccaagtcatatagatgatggggaaaatattttataggataaacaagatttaatattatgttgattagtttagtatgttgagattgataatcttcaagattttctgaaattaaagcggttatatattcaataatatctttatatgaaggttctgttgaggttttcttctttccatatttctcgaaataaaaatctaaagttctgttatctaattctttccccatacttttccacctctaaaattgtctcagaatcatacgtctgttggatattagatagtaatcttagagcagtgtttccacatgagcctttaggtaagtatagtctcatccaccatggagtaacttctaatgaaaacctatctccattgtgcaaatccactcctgaaatgtaatacatatcttcttcaacttgtttggctaacccccaaattttaaaaggttcttttactgatattagtccctctacaaagttttttaaatcttcaatttctttttcaaattcgtaaattagtggtattctatcgccccaatcacttgaagtatagtcaattagagaatcttcaataatttcaattttttgttcgtaattttctatagttttatctacaatttcattgtgtttttctattgatgttcctttaactgtaaatttcccccaataataaatatcctccaagacaaatttatctttatcatcttctgaaactatctttatttttgattttgtaattctcattaagtgtttaaattcatgtaattttttgatagtgttaaatatcttttttatttttgtatcatttaacaattggaaatccttaattagtttttcaaattcttgaatctcatctgaagataatgattggataattttaattaactcatagacactttccccattactactaattgataatttattagccctctcttcaacatcattatctaagtaaaatggagtttcatcatgtttagttgataaccccctaacataatctgctttttttaggaatttttctaaatcacctgtgggcatccataggttatctaatcttgattttattggacttattaatttattaaaatatttatcagactcttctgatttttgtaatgtgtataatttccaaaatcttgggtttttagcatctatgaaaaagtaaccttcatcaccaatacgtaacatgtagaactcatattcatctaatggttttatttttccagtttttattattcttgataattttttgggatggatattcgactctaaaatatatgtttttacaacattttgttcgggttctaatttcgtatcgtctaaaatgtctttataagacctttccatgtttctttctaaccattcgtataactgaggacgatttgttatgtcgggtatagcacttccaacaaatattgtgtccataattatcacactccttaataacagtaaaaacagtgtaaggtattaaaaaaccgtcctaataaataccagcttatttattttttgaataatttgtttttaatgaataaaaaattttctttctcactggtgtgtccaatattagagttgtgagtattatatactcatagcaacaaaagatggaaatcagagtcgtggtttattaaacataggataaaatcttgaaaatattcgataatgtcattaagaatctactttactcttagatttgaattcaataaatgatagtgttaatgttattgtttttaaatttgggtctaataatactatgtgaattgactttgaaatcaattcacgtgaggatcttatcccctcataatactccaaaaaacaaaaactattacttgtgtatgtagagtgcagaaactacacctcaaagtatgaactctagtccgcaattttgaattttctttaattatgttattattgcattgttgaattatgttgttatattattattaaattatttatttattgtattattgtcttgtaggctattataaacttgtattttgtacttccttattaatggaaatcatccattattgcttatgtgggcgttatagtattataggaagtttatattgttagaattaacattaaaaagctctaagtatctattttctagatttttagatttttatgactaaactcaaatttcaaaaacatggattgtgagtctataccgctacatataaaaagtgtgaaaagataacaatctcaattttattggattctaaattgcattacaaaattaaattgaaatattaaatgagcttaaaaaaagaagaaattaccaaccactgaataaaaatatgattaaatttgcaattattctttgttttcgcattttttttgaatgacttctaagatttctttttctaattttagtatttcatttattgttgttttaaaggtatctatttcagactttaatgtattaaatttagtatcaaacttttcatcaatcttatttacttcttcggataaaatttcaattttattccatattggagttgttacatctcttgtcgcaacaccgagtatacctctaatgaattgttttgttaccaactcttccttatttattgggaaatcatagattcttacaaaaccagatgctgattgcttataggatattataaaagcgtgtgcatactgtacattatctatggctacagctaatggattaattgaaactccagaaactccatgaggtggtgtcttattatgaggttttgtaccaacccataggggaagacttaacactatacctgatattgtcaaactaatacgtttattagtagtaatataatttggattcatgctaagcacgttttgcataactggcggattcaatttctgattatcatctgctctcccaacatattggggactatcacccatccaaacaataatttgacctgcattaagaaatctccttagtaggctgtttgatgtaggattatccggattatctaaaactaaatcaggaacaacatcttgagcaaatactaccacatattctttatttgtatctttagaaccctcccctaacaccctctgcaaactgggagcgtcaataacttcaaaatcatatttttctagttctttagatatatgcttagccacattatgaggtatccagctgtaaggataacgttcatcatagtatacatacaacttcttttcagttagtcctggtgtcatatgtttcaccctagttcactatctatatttaaaataatcttcttgatatcttctggaacttcagtaagtcttgatactatcttttctgcgattttacatttcaaatatcgttcaatcgatctaccactgtcccaccctaatgtaataataaactcttcgtctacattttttaaaactgtgaataattttccactaagtttgtgcaataaatctttttcatttttaccttcttcattcttacaagcaccaaaaattttgatttcatctataatagatttaatttcttcgtcttggagaacttcttcatatttatctttgagacattctcttagtaattcatcaagtgcgagaatgaaatcttcaggttttatgtatcctagtatatcttttttctctattataaatacttcaaaattctcacgtaagcccatatccttagctattttaacattctttaatccctcttcatcattatcagcaattaaaaacactttaatcccgtaatcctccttaaatacttttatcatctcttttagacttctttgagcatagggtattataatatagctaaatttaggaagatttttaagttgttctatgagcaaatctatgtaaccttgcagtattatccgatcgctgtttccttcgacaagtattgcgacatctgagaaaaggaaataacctggtacaacacccagatctctagcaagtgattcactaagcctgctaccacggaatggataaaagattcttgtagctagaagctctgttgggtatccttcaaagttaattttaattgaatcttttcgaacacctataacaaacctcttatctttaagagtggcaatgaaatctggagaatgtgtaactatgattaactgaacatttaaattattagctaagtcttccaacacccttgccaaacgtcttatatatgcaggatgtaagtgaatttctggctcttctatcaaaaatatatgatgttttcctttagatattattgaagctaatattccatcaataatctgatctccacttccaaaaagttcataatttaatgacataccttcatatgattttgttaaaatttcagttctatcaggttgttcatacgtgtctacacttccttttatctctctaagacaatcatataacattctaagtcgtgcaaaatcttttatcgtgtttttaatgacatttattaattcagaagataccataggatgggcaaaaaggcctttaattgggatatttaccattttatagatctcagggaatgtattcacatagcatatcttattttttataagatctatgaatatattaaagacatctttattttttatagtaccgctttccacaattacacatggcactaaagaatctccagtctttgactcgatattatgccctgtcaccttactgtggatttctttcattttctttaaagcttcttttgcaatcttggatgtctctgatacgtaaccaaatattatcacattttggagcttccatataatttgattattattactctcaatggatacttcaatatatgctttcttaacattactttctaaaccacatacctccctcaatttgtcgccttctccttcatcaaagtttagccatacagcaagttttatagggtaattctggtaagtgtaaaaccataatcttctaatttgatcttttaagttttgttcagttatggtagtgatattaagatttttctcagtagaattagtgtcgagattttcaaatatgatccttataacattaagtatcgatgtttttccagaactatttttgcctataagcactgtaactttcccaaattctacagttagatcataaatgcttctaaagttttctattttaacctgttctattttcatacactacaaccccttagtagattgtagatataacataaaaaatatactaatatcattaatttaaaaattttcattattattaaatttactattattctagaaatttgttatagagtgctatggttcttcattaagcaataagaagaagctttctaccatttccactaaaataaacataaaaaatcaaacaaaaaaacaaaacaaaataaaaataagtacaaacaaaaaatacaatcaaaaataaaacaacaataaaataaaaacttgtcaaaataagtaaattaataatttttaaactaaaaaataaaaaattaaaagagggggaggggagagcccgagagggagggggaggaaacagaaagaaaataaaaacagaaaacagtaaactaattccccacaatcaacttataatcctcctcaggaatctccctcatagccttacccatcaaatgcccactccacctcttcttattagtaataaatttaagcttcgggatcaactccttaaaattaattggtggttcaaagactttaatttcctttaatttaactctatatggaaacttctcattaggatttcttggagttggcttaaaaatttttgaactatccttataaacctctgaaacaacctcataaactcctcttatgtatgggggtttataatcctttccactcctctgaatctcataaataatcagcttatctcctactttaactttgtttatggtgtttttgtacctctctgctacaccccaaatcttcttctcttttataaccttccagttatcctcgttggttatacagagccagtatgccataagatccactataattaactttttaataactttttcaataaaaaatatttttagagcttttgtaatatataacctattagatttgggaggtactttctatatttggtggttgttatgagatttttaacgcttgtggtagtaattattttgctgttattcccagtatttgctggttgtattggtagagtttgggataatgactctgggggaggttttttgttaatacttttagaaaatgagacttcaaatatacatttaatacatctgatgtagacatttttaaattctgtaatatttctaataatgaaacctgtattgtaattgggaaaatgaataattttagtaaaaatttagaagaatgttttcaaaaatatggatatgagaattttacacttttattggctggatatattgcaaaatatcctaaatatgaagaaatctctaacaataccaaatttctaaatgaatatcataatgaagtatcaaatattactacttgcctacatgtttataaaaacttagcagagggtgttaaaagagatttcaaccttgatttactatatcttaatgattatgaaattaaaaaagtaaaatctatggttgagcctaacgtaattagtgatgcaataaccgttgtaacacttgttaatgattataataatcttattgatgctgcaagaaatgttaaaaagggagataaagaatcctatacaaaattctatattgcattgggaattgtagtgtttgatgtaattttaataaaagagaatgtggcttataaggtaagttataaacttgtaggaattttaattagtaaaacgggcttctataaagttatttacaagtatggtggaagcacagcattaaaacctatagagagttgtacacattggatatctcgaggagaaattaatagtatgcccagtaaattgtataacaattcagataaattaacaaacatttcaataaaaattaacacttcaaaactgtataacaagagtataaacactataagaagtaaaataatggaggtttcaagttagataatagaatgtttgattgttgggtctgtaactctctaatttttttatttcgttaattgttttagttgttctataaaacaaatatccaacagcttttatgttaaattttacaaataataataagggttctaaaatgttttttacacttttaatcaattttaggaacatatttttgatttctttaatagtttctttaattgagtctattattttagatttatttgttaagaagataacgaataaaactccaaatagaataattaagaaatcttcggggatttttgatagtgagttaattccttctgtgattattgttatcaatatttcaattagttttttttataatgcttgtaacaatttcaagtattgtgataataatagacgtgcatattttaaatgctaaaggtgctgtaacattcataatgcaaaatgaaaatgaaccttgacttagttcagtgagtacaacttttacttctccaactttccaaatttttataattttttggtctttaaaatctttatcacgtgttataattccatgggtatcaagtgaaagagctaaagttacaaaaggaatatcctttacatccctatgacctatcagattatatgcaattttactccaattatttgattttttatcatttattattttaatattggacagtataatattagcaatttttattgccttagattttgctttattttcgtcaatattcttctttttacatttttttgggagaacattctcaatcttattttttaactcatctacaattaattgtggagcatataattctataaaaggattattgataaaatccaatatccatgggagttcaccttttgtaacataggataatacttgtgagaatataatattagtatcaacaactaactttaatttaaactctttacctaacatatatactaaattcttctggaaataagcactaagataattaataaagtctcttcctaaagttttttctatttcattccataatttgttaaattcatcatcaaactccttaaaatactcccactcacaatcatgaaacctttgaacttcaatatttgtgagagattgcatattagccacatttaaagatttattagtatttatctaaaactttgatattataattgctataacatgtaaggattgatgagttatttgattacctgatttctgttattccctaaactatgtctaactatatccattagagtatatctcttgtcatgaaacttaattatttctaataacttttcattttctttagttttcattttcacatattcctcattgtaattgaccattttatcaccctttcattgttgttggataatattttatttaactttaacaacattataaaatatatgttctatatatttaaatgattatatatttaaataaatagaataattattataagagtgtaaacttctcatttagagttaggaatagaattaggaatttcataatatacatttacagcaaatttaccttcatctttttttatttcaatattggatacatttttaatattcgttaagaatttattgtaaatttctttagaaattacccttacaatagagtaatgtgttatttcatcatagttctcaatcggaattgataattttactggtattggttcaactttcttattatattgctctgcatttttaatttgtagttcttttttaacatcttcttctatttttctaagaatgtcatcactaatttcacttttaaggttattttcatttttatagtacttttcaacaaatttcaattttgagttgtatatatcaactggagtataaatttttactttttcttttcctaatttttttaaccatacatctattttgtatatgggcaatttttggtcaattacataataataatcatctatttttacagcaactgcaacgtgagttggataaaccaaaaagtaatgctttatatttaaattatgaagaattgcagaagttaattttgcataatctctacaaattgcatatttggtctttaatatggtttttaaagatgtagatatccaaattagacttaatgtagtaaataatccttcctttaattttaatattttactgtcacattttgataaagtaaagaacgtagcccataagtgtaagaatgttcctaccaccccacataagaacaagaatagtattatagtaattataaaatataaacagcatattataatgtgtattgtaggtgatatgcaaaatacttgttcgcaccataaccaaacttctggaaatattgcccatactaaccctactataatgaaaaatgtaataaagtaatatacattcgacttttcataacaataacgtatattactatcttcccattctaaaacattaattattgttttaatgctgttgtttttgtattttaatatttcagcaagatgttttgtgtccttcaaatcctcatcatttaattgaatatgctctaataaaataggcacaacacttcaccctgtagttcccgaatgtaattttcctacatctttaagtctcatgaattttgattctactcttatattgcatatatattttttgcatattcaaataaatcatctgaaatcttatttataagtgaataatcttttatcccttccttcattagaatgattttaagtttagctcgtattttagattggagatttttcttctttttccaatcacgagctttaatataaccagacatcattcttgcaatttcttttgcaattttttctactctttttttatctgttaggggtatattgggatatgaaagtaaaaggtcataaaatgccaactcctcttcagttagtcccaattctttaccttcttcagcagcttttctaatttctttagccaaattaactagttcttcaatcatttcggcagtggttattacctttatacggtatttctctataacttcatttaacctttctgaaaactttttaaatcttatcggattctttgccatacgaactcttatatcatcatttagaattttgataagaacatctcttacataatctttgtattctattttagcaatctcagataaaaattcatcagataaaacggaaagctccggtttttctttttttagcatttcaaagacgtctactagctctttagcactaatacttttagatattaaactttgtatgtcattttcaaggtcttgagaaatctcacggatttttttagtggaatatttaacaatcatcttttttatcatttcaaagaattctaaatcatctttaatacctattgtttcaggatgaggtcgagcaagtaagtaaagcttttttaatgctataacattcctaacaaattcttttttggtattatcatcttttgctactctttgataagcttttactgtaagtagggataagtcttctgaagataactttttccaatctttgtaattaatatttttaaagtatgatgttaccttttcatatctacgcttcatctcttcaataactactttaatgtcagtcattaaatcctttctcgcctcacttgaatatttagaaagggatttagataaatcatcggcaattcctatataatctacaataagccctcctggtttatctttaaatactctattcacccttgctattgcctgtgctaatgaatgatttttcatcggttttaagaaatacatcgtatgtaagcagggaacatcaaaacctgtaagccacatatcgacaactataaccatctttaaatctgactctgggtctttgaattctttggctaagttttcaagctccttttttgttcttatatgtgggtggaaatcttcagggtcttttgatttattcccagacattacaacggcaatctttggagcatttggctgtttagtaatccatttatataattctactgctacttttctactaatagtaactaccatagcctttccatcgaaatcttgaagacgtttgttaaaatgctctataatatcctttgaaaccttggagagataatcctctgtaagcatgattttttcaagtttggcaaatacttcttttatactctcttttgtttctgggtcattggctactctttcagagatttcatcaaactctaaatcaatgaattcatttgtaagatgtaattctacaagtcgggcttcataataaattggaacaactactccatgcctctttgccttatcaattggataggcacttatataatctccaaatactaagaatgttgaacggtctttgtagtctattggagtggctgtgaatgccaaaaatgatgcgttaggaatagcttttctaagattttgagctaatgttccataatggcttctatgggcttcatctgcaattatgattatgttgtttctatcagttaggaaagggtagtgttcatcttttgactttctaccaaatttttgtattgtagcaaaaattattcctccaggtgttttcttaatgagttcttgaagctcagctatactttcagctctttcagcctctgaaaaaacacttgaaaaaacattatatagttgttcatcaagttctaatctatctgtgaggaatactaagaggggataatttaattctttctgtttaagtgcttttttggcataaaataacattgttatagatttacctgtcccttgtgcatgccatacaataccgattctcctatcttcaggagtttctccataaagtacggattttattgttctatctacggcttttttaactgtataaaattgataataagtggctataatctttttcttatcatggatgataaagtcctcgaggaattcaataagatgttcttttttaaataaacccattaaaagtatgtctaagcttgtatatgggtttcctttatatttatacattgtatttccataattatcaacttctataacttcaacatcgtcatcactttcaactccttcccaaacaaagaatctatcccaatcacttgttggagaaccgtattttgtttctaaaccgtcgctaacaacgagtatttgggcatattggtatagttgaggaatatctttcatttttgttttatggtcgttaaatgcatctttggctgtttgattggattttgggcttttaaattcaaaaattgcaatgggaattccatttataaatacaactaagtcgggtcttctaaatcttccattttcataatagtattcaacctcaaattgattggctactaaaaattcatttttatttatattttcaaagtctatcaattttacaaatcttgttttcttttctccattttctttaaattctaatttaactccattaattagcatttcataaaatatttttccacgcatattgaaatctgggttatctatgttggttacagttttataaactttaagtgctaattcttcagtaagccatgggttgatattctttatagcttttataaatcggtttttaagtattgcatctctgtaagattccctctcattatattctggagttagttcagaaccatgtttataggaataaccaagatttttgagtctttgtatcgctgcattttctacaacgtaatcttcatttaattttgcagcttcttttttcattttatcaccaatgaatacccccactaataaaaaatatttatttgcagatattggcattatctaatttagcaattaaaaaaaatttttataattcttcaactctcaactctccaaataccaattttggtaataaagcatctctaatttttttcaaaaccataatttgtttttgattgtttataattttttcgaacaatggttgaactaatgaatggaatttttgtagtattggttgtggtgggataattatatatttattttcaatatctgaaatttttaaataaggtaaagtagttccttttacactatatacaatttcttttagtaaaaatctcaaaagacagtaaataaagtaatgcttttcatttagcatgctactatctataacagcaagatgatttactgcagtaaatttaaaaggaactatatttactcgagcttctttcaaagactctccacttttttgaaatatgatacttttttcattatataatttcattttataatcttttaaagccaattcatttataaaatctgaagattcaatacaaactccttttactaaatgttttactcttacaaatgggattttagcgttttcaaagtatatttctctttgtggtgcattacttccagattcaacttttaaaatatctcccaatctcttgacttcccaacccttcggaatctctttatccaattcatcattataaacaaactcttcatttttaaacggctcaaaatctataaaccaatttttaaataattctaaagctattttttctaaaatttcattttgttttttcttattttcaattaaatcatcaaaatatgataaaacagttgctattttttgttgttcttctggtgaaggatatggtatttcaacttcttttaatgtgctaccttttaattctggaaatgtagaacctccagaaatatctttcaaatattcactcattgtttttgtcttaaataaatagtaaagatattcactaaccacgccatcctttggaataatatttctaaatccttgatttgttgttagtggattttttgcaatagccacataaccaataggtgctcttgatgttagtaagattgttccttttggaaatattctcaatgaacactctttaacagctttttctgtaatgtttctttcccctcttgaaatgtaaatatactcataattagcaaggtcttttggagttatccaaggaatatcccctccccaatattctttaatttttgtagaaggtgttgaaccaccagcaacttcgccaatatctttaattttcttaacatcccaatccttaggaattttcccaatatctgtttctttaaattctgtttcccatctaaatttaaccataaataacacctcaatatgtaattgctccccagagtaaaactaaaccagttataaatgatgaaccaatggatgctataatgtaaaattcttttggtaatgaaattctaaaaatatagctaaaaaaggcaacaatccctataattgtcataatatctatataaataactaaccaaagaggcaaaggatgcaaattataaaagtaagtaattaaagcaacaaaatttaaaamtaatgccatccttccagtataatgcttttcaacaaaatgtcctactaagagtaatgaaaatggtcctattaaaggtattacattatctggtaaaaaatatgccaacaaaattttcattcaaaccaccaaaatatttattttaaaaccctaaagcatccaaaatctctttaaccttattcctcaacttctcttcttcatctaacaacttctttaactcctcagaatactctttcatcttaacctcaaaaggtattccatcatcttcaatcttaaccccaacatacctaccaggagttaaaacatatccatttttagcaatctcatcaatagtagcaaccttggcaaaaccaagttcatttattttgtcttcatcttccccactttcaaacattctaaacttatcaacaatcttttttatatgctcttcagttaaaatattctgccttcttgaaatctgcttatataaattcttcgcattaataaacaaaacctttcccttcatataatctggcttctccttccttataaaccatagagaaacaggcaaacttacattataaaacaactttggagggcatgcaacaattccatacacaaggtcgttctctattattgccttccttatttccccctctacatttccagcagacaatgcaccatttgccataacaaagccagcttttccattgggtgctgtatgataaataaagtgtagtatccacatatagtttgcattaccatttggaggcactgggacttttttatttccaattctaagtcttgggtcatctggttttattctatttgcatcccattcactatcattaaatggagggttagcaactacataatcaaaagtcatatccataaatttatcatcatgatatgaatcatctatacgaatatctccttcagcccctctaataataaggttcatttttgtgagcctataggccattgggtcagaatcttgtccataaattgataactcatttatatctattccctccctctctaatttttcaagtgctgaaacaaaaaatccaccgctaccacaagctgggtcaaatatactccctcctttgacatctaaaacatccacaataagttttgttaaagaccttggagtataaaactttcctccaagttttccctcaacctctgtaaattttcctaagaaatattcataaatcctaccaaacacatctttaactctatgttctttcccaaaacttatttctgaaaatttatttatgagataggagtagtcatggttatcaaggggagattgtgcatagattttaggaattacatcttttaacctatcaggatatttttcctctaatatctctatagctgtatcaataatttctccaatatttggactcattacattttctacaaaataatcccatcttgtttccttaggaagataaagaactccttcagagagataaaaatcttcatcttcgagaatcatttttctaagttctgggtcttcagtgtataactcactatttggattagaaagttcctcttcaatctcttttctcctctcataaaatctacaagttaaagctctcaaaaatataagccccaaaacaacatacttatactgatgaacttccatcttctttctaagcttatctgccactttccataactgattttcaaactctggtgtgagttcaaaatggtcatgtgataccaatgattcagaagttttgttagatttagatgattttttcttactttctttctttttagttttttcatcattttctttaatacttaagaatttatcgagtgttgccataatacatcaccatatacattgtaatttttagtgtatctttctgcggatactaggaatggaataatataaactaacctctaatttaatcctaagctttctattcatttaagttataggatttttacaaatatatttaaatattagttaatgataaacaaatctctttacatagagaggttatggcactcctaacagatattcgattttagttatctcctaaactataccaagtaatttttttagattattttgccatttaggcaatcaatgattttttcaaatttattagcaagttctggattttcatataattttctttttattgttattgctacatcgacttttgagaaatctcctaagttatttaatctaaactcattattaagttcttcaattattttagattttgattttcttaatttttcaacgatttctttaacttttttgaacttttctaggtcatgagtgaagattcttttataagtttctaagacacaatctaaatagaagtttttatcaattaaatcttcaatttcttgattttcatctcctaaaaatattattttattacttattttatctctttcaaatttttctttcttatccccatctaataagaaatagtatttaatttcttcaaaatttgataagcatgaatatagtctgacttttttaactatctcgttatcttcaagtttatctccaccagacaatggatgaatataccaattttttaagtttttaagtgtttctaattttcctaatccttctaaaataaatttatccgaaattccttcaacaaataaaattttacttaaattttctttgaatagtattttatcaactcctaatgctctcctaattggataaattatgtctttttgttcattactccaaggtctctttatttttgttctattttctttatcaagatatactaataagactctatcaagctcttcttcattaaataacgacataagatgggtattatataggatttgatattcttttgataattcttcaagtttctctaaaaatgatttttgaacatttggatgcaaataaactgcagggtcgtcaagcagtaaaactatatcattattccccccattttttaaaattctcaaatattcaagtgttataagataagctaaataccatttaaatcctttagacctatattccggaagagttattttaataggttcgtttttattatcacgctcttcaatttcaaaagacatttctctttctgatatttgtatcccaatcattatatttttatcccaatatttttttaacattttagagaactctatacaactatttcttaaaattattctctgtatatataatggctttttttcgaaatcttctatgtctatattcattactctaaaaagtctggcattaatagagtagtcttattctcttcttttaatgtattactccaagatgtattttttataaccgctccttttaattccatttcttcgtctaaataaacaaattttggctttaagtttataaatgcaatagtaactattgaattaaacttagtaagaatttctgtgaatatattatacgggtttaattggatgtttctacctggaatagatatagatacagaagtatttggaatacttttaactatattttcaattcgtttgcatatttcataaaattcttcaaaagtattcaacgttctaatctcatctaaaattttacgataatggttattaaaattagggttgcccctaatattagcaactgcattagaaatttgattttcaggaatattctgtttttttacttcttcttttaatacttcttcataaattagattaaataaatctaatggtgtttttttggaaatcacatttttaaaacagtcataaaattcttttgttatatcttccaattggtcgtcataaatatatgttttaaataacccatcagcatatttctcaaattttaagaattgaattttatttagcatatcttcaaagtttattaagatatcctcgttgatatctactttaattacttctaaaatttcttttatattagaaattattttttctttgaacttatctttattaacaatctcaaaataagcttctatgataggttttttagaatattctttattttcttttcctaaaaattcaactggtatatcatctccccctaaaggtttatctgtcccaaaccaatttaatgcctttaggatatttgatttaccactttcatttgctcctacaaagacagcaatatctccaatattgtttatgtgtgctactttgatagacctgaagttcctaattgttaccttcgttaagtgaagagtttttgtcattaatctatccccccactttataaacaaaatgtcctaaaactaaaataaaactcccgatttcattaaatgtacaaaatgtattatgttgatttggtattata

SEQ ID NO: 3 - DNA, 16550 bp, Methanococcus jannaschii
tataaatagtatagtaacccctataaacaataaaaggaatatataaacaaaattcataaacaatcccttttcaatgtttggtttatttatagtaaagatttaatatcctcgtattattctacaccccattttcaataatcctaacccactcatgagatattattttcttaattaatttgtttatttctttatcaccttttattgattcataaacttcattaattgtttttagattttcttcctctaattgttttaattcctcttcctcttcttctgttaaatcgccttctaacagctttttccaatacaattcagcccatctatcataatttattggttttaagtgctttgaaattgtttctaatagatgttcttcatccccactgtataattttgtttggagcggagcttttaaggaacttggttaattaaagaaatcccagtttattaagtatatctttttcaagaatctcaaggatttctaagacatctcgaccttttgtaattggtctgataatccaatattctgcatttttctgttttaagtcatcatgttctccatagttttctaagtcatcaaatgtgcaaccccctacaaaataaacttttacgttatttttaaaataatccagagctttatttttttcctgtttaaaagcattttctaatcttttgttatattcccatttttttaagtgaggattatatccataatctcctggattgtgaaatattattctaaaataataatctttattatgttctttcgacttataagatgtagtgtatgaacccaatatatcaaaatctttatttaaaatgtcatttaagtcatatttagtggctattgatgacctaatctctattgtaattatctcatcatttgaaagatgaatttctatgtcattgtgggattcatagttaaaattttcattgcttacatttgcacctttgatttcaatgtaatcttttattaacattaatttttcagtaattaattgttttacaactttttctgcaataagtccgcaaaatgatgacaataattttctttcttctgttcttatatctccacttggattcttttcacaaacatcttctgctaattttttagcttcatcatggatattatttaattcattatcatctaattctacttttattactacaaaaatatttttttgtgatataggggttattttgcttccattatatttatttataggatgtctatagtatttttcaaatataaatttcatacaatcaccttaatttttattccgtatcttacgcaccaattcatttgtatttatggtatttagtaatttaataatattttggcagtattttaagcagtctatggatttttcgtcatacttttttatgatgccattaatttcattgcagatttcgtttaattcctcttttggtattaagtcttggaagtaaatcccataaactaatgaatctattatattttctaaaaatattctgtcattttcatttaatttatcgtttaattcgaacctcaatttacttaactgtgttaaagcgtttattatgtttttatttttggggattactataggtaactctcttaattcttctaaggtagtctgcctaaaatcatcttttaatgctattgccgactttccaatgtatatataagatattaactcactatttagtattcctaataaatagaagtaattaataggagtatctggctttaaaacaaacacatacaaatccttttttacaactccttcaatatttccataagatgccataattctatcttgtctattaacgattctccgtataaagattttctcgggagacataaatagattaataagcttttcgttgtttttatgttttgagaaatcaacataattttttaattttaatttagtttcatacctatacacattaccttctaaatatggcaaataatattcgttttcttttttatctgaaaatttatattttgaagctaaaattcctattgtagattctgttaaatcttccaagtaagttagtgattctctacaattttgtttaattttatctaatattatgtagatttcgggactttttgggaatattcgacactttgggtcatttaatatttttgaatattctatgaaaaggtcatttttaaactcaaatgagatttttttagtttttttagggaatgcatatatcaaaaccaaatcttctgattttggaggttttttatgcagtattattatacaattatcaacatacgctcctgaaaatacatcaaaaggtagatagattaattttttcagacacatttttgtaaataactcttttctaagatttgaatatctcacacccgttccaaaacttgatgggattataaatcctaaatacccctcatttttcaataatttactactatgcactataaatgttacaaaaatgtcaaattcaggagtatctctacgtttcataatttctttttcagtaggagatagcaaattcccataaggtggatttccaataattacatcaaaaccttcctctttaataatccatccgaagtcaatcttccaatggaagggttttaatttttcaaattcctcaacacgtggtctattctttttactttttttaccattattctttttgttatttccattttggtaaatctcagcgaaatatgctggagttacactctcatatattgaatctctaatttcatctaataattcttttaacagattggctttaagtccgtggcttgttctatatacttcataaaggagatgatacgcttccacataattgtctaatacatatccatctcttttttcaagcaattctttagcttttttcagtttttttctctcttcagaattgtgagcgttgataattaaaccttcaagaacacacattatacgcacattatcgcataggtaggagatggaaagctgttttaaattttcatcaatccatccaactaaactgttaccacatcttacattatactcaatatttggcagtaaaacttctcctctttttaaagcctcaacgtctaaattctcaataagagcaagccacaacctaagttttgctatttcaacagcaatatcatcaatatcaacaccataaagattgtttagtataatacctaacttttctttgtaaatgtccatctcttctctaagtaaataataaatccttttcttaatttggagcaattcctttaatgcagatattaagaaatgaccacttccaactgcggggtctaaaattcttattttatccaattcatcaagaaaagctcttaaaatatgtttattttcagctattttactatcttcattaagaatttcatctaatgttgagaaattaatgtcatttattttccaatttttaataatctctttaaacctctctacaacaatcggctctattgtatttttggcaatatagcttgtaatctcatctggagtataataagcacccagtcctttctgccctttttctgccaaaatattaattaacttttcataaacatacccaagaatatctggatttaattcaacttcttctgaaccttcagatgtagatagagtgaatttatacctttctaaaaaattaataacctctccaataatttcattatcttttatagtaaatgatagttcgttaggaacattattactcctgaataatccaccatttaagtaagggatgtctttatagtaaggattagttctaatattttcttttctttcatcttctggagtattaagcacttcatagaataatggtttaagataagcatcataataatttattaaaacgttagattttttgtaatcttcataagttcttctaagcaaatctcttgggactattcccttgtcctcaaggaattttataaatattaacctgttcattaacaatactgcaaattttttcttgtccaattctgatgtattgggtggagcttcaatacaattgtataagcattttttagtgcctttatctttttctgaactacttttatcttttttcttaacatccttaacatcttcaaatccaaaaacaagttttacgaactctttatagaattcattagtaatttcttcttttttatgtttaatattctttgtagcaacttcaatatattcttcaatatactcctttgaaaaacaataataaaactcagaaaatacctgttttaattcattttctaaatctttatcttttttattttcaagaacatactcaaaaatagatttaagattcaattctttgagagttcttatttctttaattgtatcatcatagtgtaataacacccattctaaaccattagtggctataccagtatctacgccataagatttgataattaaccactccttaacctggtgaattccagaatcttttttatttaaatcactacctaaaggttcggcttcgataagaatttctttgttaaatactgatactctataatcaggaatttttctatctcctaatggtgattttttagatatttctgatgtgaattcataacccaagaattctaaaattggttctataaccttctgcctcgtaaatggttctggaagttgccctccaaaatcatcagatttaaaattgtatctaccctttttcaataactctttaaatttgccttctaattctggaatttgcttaatagacaaaataatattcccaacaagcttaataaaatccttccacttgttataaacttcttttggaatttctatatcagaacacaattttgtttgagccataactaccacctaacatctaaaaaatttaaattattgattaatttaaagtttctttaaaatttgctcatattcgtcctcttttacatattttccacaaactggaataaatctctttggcttaacaacttttggatactttctaatattttttaagatgataactatccatggttttttctttttcttaccatatccccactttttatttgaatcttcaatatattttttaaattcctcttctgttaaaaataaattatttttatatttctcaagtatcttcataggattttcaaaaaattctacttcctcaatctctgcctctccataaaatccctgctcttcccttgaagcataaaatattatcttcattcccttttcaagttttggttaatgttgctggtttgacaaaaacatttttatgctcatccaaaatcctaccaattaatgacttgggaattggaaatgtagctcctacaattttatcatccataacctcacctctattatgtagaatattttaatatagtgtttaaaatttattcttcaacctcactattttaaccctacctttcttaacaatctcaactcttccctcttttttaagttcatttaatgcagtataaaactttctcgtatcaacttcaagtatttcaattaatttccgtaatgcaataatctttttcagattgtaagagttccaacaatctatttttaacatcatctactgtattagaagattctttcaaattatttccatgtgaaatgttaattattaaaccattaaccaaagtagataatgtatttagttgattaacaatgtcattcaattctttcttgctaacataatcattattgttagagttaataacattattaaactctaattgaattctttcaatttctttcttaatgaaatttagttcgttttcaaaattatctaattttttattcaatttttcaaaattttcaaagatttcttttctttcaccctctaactcttcaattttttcaatatagttatcaatgcctaacagcttaataatagcctttttaagcataataacagctccaagcagtgattaggtttcattacctttcattactcatcattattataaatatagtaaataaaatttaccttatttttaatgtgtccctcaattaatttattatacaaaatgactgtccatattgataaaatcggcaatatacgctctataagtggtatgcactttgaaaattcttaacttatcctgaacttttaggcaaccaataataaataatatgcaatctcctttttaattgattaattaatcaattaagcaattaattgagtatcaattgattaattgcaaaactttttatacttcaattgagaaaagaaaatggttgaaaatagttaaaaacgaaaagcttatattttcttagaaatatacaactaaaaaaggttatctactctcaattggttattacacaaaaagcctacccaatttacaaacttggaattaactcacctgtttatataaatgttactaaaaattagaaaagtagaaagataatgcccttatggtgttgtcatggaaagtaaagaatatcgcaaattagagtataactataaagcttttttaattttttctaaagttgccatgctaacatttctaaccgtcggtattggtgctatatttacgccacaaacatatccaataatgccaaccattggttttatagttgttgctggaatcgtatccttaataggtatgactatcggagcattaattattcaccaacaatatgagacgttaccagctaacgaaaagttagaatttaaacaaaaactcctaccagaagcatactacatttgtatagaattgtttggttacggttcattagtattattatacaacacatttacatcaaacaatcctacattatgcgttatgtctctattaatggcaggattgtttatattggtagtcttagtaatctggtattttggctacaaaagttattaagtatcttattccttagatgcatccttaactggctttttaaatagccaataattcaaaactgcaaaggcaataattaacaatccatacatcaacatggcagtaaagaatatccacaaattagcatcttccataaccaccagcccctatttttctacttatgattatggcaactaatgagatataaacctttactcctctaacggaattaaagcaacaatatgccctttttggattataatcctctcaacttccttatcatcaaccttagcgtccaaaaccataatattaaacctatcctttgccttgacagttccctcaacaatcataccattatctaagtaaattttacactttttcttatgagcaaataatagcatataatccttataatcgtcatccttcttcttaggttgctttttcatcggttttctttgtggtttattctgcttattcaaattctcaacctccttagctattatatcataatgcttacttttaatgtgctttttaattgcctttacatctgcattagtgtaattacagtatggacatttatagaaaaatccctctttctgtatttccaatttttcaatataatcatctatgttcattttttcaccaaatagttatttttatccaactcataatactttttataaatctctatttgcgtttttgcctctggtatgttctcttttagccacttaatagagcatactttaccattcctatcatagagatacctaacttcataatctatatgtttgatgtatttgttgccatacttggaagcccaacggttcaataactttatagttttatctcttccatagcctaacagcttacataatgaagttaaataataacagcctctcattttgccatcttcccaattggaattgattaactcattaaggtagctctccaactttaccttatttaatacaacttccttatctcctatggttgttttgatgtattccctcttactatgctctaccttaggttttgccttcttattggtgtttatttccaaatctatcttaatatcgttattcactttcttagttgcttgataatatcttaaagcatcatccacaaagtccgttaaatcccctcttatctctccaaagttttcatagtattttgttagcttccttatgaagtatggctttacattctgcaaatatatcggtttaaacttctccactttgttaattggaaacggtatgcttatcggtgtctttccctcaatgtctgcatagtataagctaaatggtgctgttacagtcatgttttccttatagattgataagtcaatacccgtatctccttccttgccaacaaaatctaacaacttccttagcttaaagtttagaaagtttgttaatatggtgcttccttcaacatagcccttatttagtatctcattaggcaaatatctggcattaatccaaatatgaaagcccttactcccactaaactttatgtggatgtccttaactccataatctttaaaaatctctcttacttccttagctatctccttagatttcttaaagttgcctttaaagtcaatatctataacccaatcccaataattgtagtcgatagctggatactccaactcatatcttggactctcaaagtagtatggagagcagtaaatactcctaaggttctctataatccaatccttaaagttgcctctataatcccataaatcaatatgccttaaatatggcttctccccctttgggatgttgttatagttccaatactttggatgtctccaattgatttttctatctctatccaaatccaacctatggcaacttaataacctatctaaacaaaaataatataaatatctggaagttagtttatagtaggtaagcctatccatagctaccaccattatagtggtctccattggtcggattctggattatccacatctccatttttccacagctcttttaaaatcccccgtgctgtatcttccgatatgttgaagttttcagcaatttcaaccgtagtgtagatttttggattttgtagcatgtagtttaaaatctctctttttagttgggataacttcctactttcctctataagtttgttaatctcttctaactcttcatccttttgttgtgtttcttttatctcttctccaaccaatttaaatatctccttaaccttatctggtgctttaattcttaacaaaacccctaagattgtcttaaaccatatttttaatgcatccctaacatcctctaaatccacatactccttaaacttaagtttagcataagctttagccatatactcaatttgattaaataatctatcggaatatcctttaaatagtccgtaatctctcaataaatcccttaacttctcctctacctcccaaagtgtctttaatgcatcttccttaaactcaatatccttatttttaatgtagctaatgaataaagcacactcgtaagcttccaaattcttttgttttatgaagttattgtcttctctcaatctcttaactttgtaggtgtgtagtttaatctccttccaatcctcgttggtgtatggctttaatagatagattaatggaattctatctgtcattcccctcaaattcttcaaagtaaaatccaatatttttgacaataaccattctgatgcatttaactgggggttagctcccaatatattattaactatctttttagccctatcttctgcctcatttctatcatagtcatgttgttttagtaactttttagcgaagtaatttatcatagcttctttaaactcttcaaatccctttaagtggtaaatttcccaaagctccattaagtcaatatccttaatgttccctactccaatccatgggcttaccccaatcattgggatgttataaccctctctttctctcttccaaatacctgaagttttaccactttttaataagtctaagtcgttgcctactcttaaaataaagtccatcatctcttcaataaatatcggtctattgtggttcattgggattattccttttttatagaattttatgttatctctggagataactaaacctattaagttctctatgttaggcatatctactcttatcatgtcctcagtagtgttgtggagttttgccaatggttctattgttaaactcttcccttgtccatagcttccaatgaacaaacaatcaatagtttcaggctttaagtgtccatccctatttttatcccaatatatatgggatgatgccagtatctccaatgttattaaagtgtctatcgttggatttttcccttctttgtccaatattgccttcacttcgtaaaataccctatctttaatataatctaaggcattactataaccagcattcttaaccttcctaacaaaggcatcataattgaaatttatggtcttttgtggattgatacttaagccctctatgtaatactctcctttatggtttgttttcaaaattcctacaatttcaacatcccttaggttgttaatctctggtgtgtatggaagataaaccctataaacttcatccgtttcttttaattggattatggctatcgttaaatccctttccaactttattggttctccatcttcatctttgaatagggattctgaatattttatgtctctgccacactctggacacttaattttataatcttggctgttttccactggctcatacaaccttataacttcacaattacatcccttgttattgccgttcttatccaaatcaatacatacataacgtctcaaaattggtctgcttttcctatggtgtattattcccgcaatatctcccctaaatacacacaatttattcctaaactctccccaatccttagcttttgtcattatggtcctacttcttagtgtctctaagccaattatgttaatctctaaaggcttaaattggaagtatttttcataataaactttataaatcatctctatggcttcatacggttcatttaagagtaagctcctaaagtaagcccctacaattctctctttgccctttaacctatcaacttcgttaatgtcaaattcaaagccctctggtgttaatctctcttctatgaattttttaagtgattttttcaaatcttccataaattcgcttttagcttctgcctcttggaatgcttttttaggtaaatactcatctaagatgtctttaatgtcttcatagaatttgtaagttagataaatgtattttctatcgtaatcctctggatttttccttatgtcaatccattctaattgtttgtaaatctttaggtgttgctttaatgttccttctccaattttcaactgctctatggctttattcataaattcgtcaaatctcataccttcaaaggttaggattgtgaatattttagcagtttttttacaatcatcgtttttataactcttttttaatgtgttggctctctcgccgattttgttgcataggtcttcaatcatactattatcttgtatattatgcagtaattggtgaagcatagtgaagtcgttattttgttggtgaagtgcagtgaattcttcaccacattggtgaagcatagtgaagtcgttattttgttggtgaagtgcagtgaattcttcaccaacaatttcaccaatttttatgtctctattttgttggtgaagcatttcaccagctttcaccaattttaatacgacttccttagggtcgtgtatctcccagaagctccaacctaaaattgacgtaattgcatcctccaatctatatagtttgtcggttggcaattctgcccctaactcccataaaccatattttaataatagttgcctctctttcagaggtagcttgtttaatgaaaatagccatatatttcctaagatttcagtattgtttttgttatgctcgtctaattctttgatagtattagggtcatatctaatgttcagtaattttatggcaacctctaaaacatcctctggatattgattaatttcattaattgtatattccaatacattgttgttctgtatgttatttatactaccatttacatatttatccatgcctaaccacctctgttgttgttaggtttttcggagttttgagggtatggagataccttttataggttctccctatcttttccagtatatttaataaagctatttttgaagttttaactttataaacattaaatgatgttcttttatgtagcattatcaacttgaaagcattattttcaaattcgtgatatagaaatctttcaaaagttgatattgcaaatacttttatggaacatatacaattatccacatttattctattgtatcctaaaatcagtttagttaaatattccaatttatataatttatgtgttgaagcatcttgatatttaaccaatgaaccacaacttaaaaataacatctcatcttccaaaggtagattacacaatgaaaatagccaatgggataaacttaattttatataatacaacttactataatagttagttagtaactttatagtgcctttcaatacattgtcagaatagcatttaatccatttaaccaaatattccaaatctatgataatcaaaaaatatatataattgtttatgacacacatataatcacctcctttgcagtggttttccaagtattttcccaatttggggaaggaagggggcttaacactattttttttaatttcaaagtatataaaccttacgaaattatcggaattatctgttccatattcaggtaatggcataaaagcttactggattatatttaactattaaaatttattaattttattgagaataatgcggaatttttacgcagaggaattttttattatccaaactatcgatttagatagttctgatagatttaaactattgaagttattttatgtaatattttctaaaatttacggacattttccgagattgctaccacgatattgtataattaaacaaacaccacttaggtgaaaaatataccagtaaagaatacattcatctcggaaaatatccgtaacggaaaattttcaatgcacaaacttttaattatctgtaaatataaaaattgtcaataattattttatatttaccagtgaaatttgaaaacgtgaaataatatcttacatgtcattatactcggaattttgcaagtccttatatttgaaatatcggttacacacactattgtaaaatactcgtacttatcggaaattttccgtgcggacatttttcgaaggaagacataattttaagccataacaacataaaagagaatggattacaaatactacttcggaaaatatccgcacggaaaattttcgcagtcagtagtatatacatcttccataagttttgtaggtatgttatattcatgttcatcaacgtttttttctttcatcatgagataatttacaattgctaaaatcaatattaatattataaatccgagaattatcgccttccacctaatttttccagattctaatgtttcacataatacgcctaaaccaaatataaaactaaaagcaccagtaatcgaataaataactgattttggaggaatattttcaagattctctataaacaactgctcagaacgtgatttcagaactctatctattatttctctgtagcacttattatcgttttctttggttttcgaatcatttatattttcttcaatttttaagttttgattattatttataatttgaatatcattttccgtttttttaacgtttaacgagttttctatattttcgttaattttaaacgtcttaaatagctgtaaagcaacatcaattaatttttttccagataatttcataagattattgtattcatccaatatttctaaagtatgagttttatttttcttagaatataagtgctttaggtttaaaattttattttgtatgattattttgtatgttttttcattaattttcattacatgtccgattttttcaaatattgataataacttttcaaaaccttttactccaacgttaaaatttccagttttagaagataacgaatatctcttatttttactatcataagttgccgatatttctaagtaactaatatttacataaaaattacagataatttcgtcgggcatattcgacacctttttaaaattcaactgtaaattgacggtttggtagtattatattattgtgattacaaagaatatacctttcggaaaatatccgcaacggaaaatttccgaagttagtagtgagacattgaacctatatgttttaagagttagaacatgcccaaaacatgcttgtatattatatatgtaatgagtaaattatgattagtatatttttatccaaaaaatagagttcaaaattagcgttgctaaatcccataacttatgtggctataaagtaataaggttatgaaattatgaaattcctaacttccataaacttctggaaattcacaactttcacaaagttgtaaatgttataaacttcagtagtgtccaaaaattattaacctaagttagactttgggctgaaagtccaacttctattaactttgagaccatttaatatgtgcatatttttaaatatggaatataccctattaatccatacaaaaatattaggtgagtgggggatgttatctaaaatcgaacgacttatattggcaaaccaatacaaaattttgaaaattttggaaaatacttcagaatatgatgagataattaagattttagaggaagggtatgaaatattttatgatgaaattttaggacatatttttgatgaacttccagaatctgaaggacaatttgtattagatattctctctttttacgacattgtagttgaaccctacaaacaaaagaaccctaatgaccatgaaataataaatcatccatattcgtattttaaaggttttgatggcaatagcgaaacaaaatatatggcgtttgtaagatttcttatagaagaccagaaaaaattttcattcgtagcaaagtatgcaaagaaaactgataattttaatagtcatttcccaatgttggataaatatagaaaaatggtagagttatgggaatcgaaatacaataaaaagtatgacttaaaaagggaggaaattcttgacatcctaaatgcataattttatttatctaaatatatttttagatttttattttattataaaattcaaaaaatatcttatcgtattatagaaagatttgtaataaactcattataatagtgaaatcttacttcgaaaatttctaaccttggctgaactttgttgattaagttcaggataaacaaaaaataaaaagaacaatgattttaaactcactatcagtgtagagattggcattaactatttatttgtatttatctatcatactgagagtttttttattttcttttattgctttattgatttttctttgaatgattctagtactattttctcataaggaaaaatgtttggtttgtcatcttaaatttaagtgatttgataaattataattatcccaacttaaactgtaaatgaactacaatatcctttcctttttgtttaagttctatatcttttatttttgaacaatttccacagaattcttttcttaatatgttttttatgtatcggcataaagattctttgattattgcatcgtttatatcataccaaattgcataatttttgagttcgaattcaaaatttggctttttactcttcattacctcatatatttctttaataatattgtcccagttaggtttaatatattcttcatttaataagtttttatcgatatatttttcaatattttctttctgtgagtcaaaaccatttttctttcgtattattttatagattttataccctcttcctaaaatcctatggttagtggattgtatttttatccatgtgttaatttcacgaatgggtagtcgttggtctattacatagatttttccatttatctcaatagctgcagcaacatgcataggatgagttactaaatataagttatagttgggaaacaaattcgaaagtaaagcaatagttagtttagcataatctctacatactgcttttttgtattttagaattttggacactttaatatcataacataaagtatcatgcagcatagcgattgctgatacaaaatttccattgcattgaaacaaatattttactatcaatgtaagtattaacacccaaagtcctgaaattatactaataattataagattttcactgaaaatatacaatgtgaagatacttactaacaacaacatgctaatgttgtttaagtattgtgaatattttgatggcaatgatattaatactaagagagccactactgcagatattacccatagtatcaataccataatatcattgattataatctcaaaacctattatcaataacaataccataaataacaataccacaccatataacatagccgcaataacataataaattaaagaatctgccgctctttccatccaatatctaatattagtttcttgccattccaaaatattatttaaagtttcaacaattgaattttcccataactgttcagacagtttttttatttcgttactataaatttcttttagagaaggaatacttaaaaagtgtgacaactt

SEQ ID NO: 4 - DNA, 17 bp, Methanococcus jannaschii
ccctctcgggctctccc

SEQ ID NO: 5 - protein, 335 aa, Methanococcus jannaschii
MKFYNREKELNYLKTYCQLDPNSILFVYGPKSSGKSTVMRRVIKELEDSNIVFFYYNLRKYATYSKEEFLRVFFEKSEKKYLLNKLELNLGVFKFGVEENFDFNNLKLNDVFAKINESINAVVEDGKKPVLIIDELQKLKNIYFNGGKSLLNELFNLFVSLTKMEHLCHVICLTSDTLFIEEIYQSSTLENTSKYYLIDWLRKGTIRNLKEEGFSEEEINYCLDYLSLPYEIVDLIENKKLGLSVEETIRQWINIEKDKIKYLIDTTDLDEEELYKVLSKFKDKIKISYEKEVKKEEMKYFKFLIKNEILFYDVINGIIKPTSVKKWYAIREILK

SEQ ID NO: 6 - protein, 339 aa, Methanococcus jannaschii
MKFYDREKELNYLKTYCQLEPNSILFVYGPKSSGKSTVMRRVIKELENSNIVFFYYNLRKYATPTRDEFLRVFFEKSDKKYLLNKLELNLGVCKFGIEENFDFNNLCLNDVFAKINESINAVVEEGKKPVLIIDELQKLKNIYFNGGKSLLNELFNLFVSLTKMEHLCHVICLTSDTLFIDEIYRNSTLKNASEYYLIDWLRKGTIRNILKEEGFSEEEINYALDYLSLPYEISQLINNKKLGLSVEQTIKQWINVEKDGLKYLIDTTDLDEEGLYNVLSKFKDKIKISYDKEVKKEEMKYLKFLIENEILFYDVINGIIKPTSIIEWHAIKEIINAMQ

SEQ ID NO: 7 - protein, 337 aa, Methanococcus jannaschii
MRFYNREKELNYLKNYVQLEPNSILFVYGPKSSGKSTVMMRVIKELENSNIVFFYYNLRKYATPTKDEFLSIFFEKSDKKYLLNKLEINLKIFKFGIEENFDFNNIKLNDVFAKINESINTVIKDGKRPVLVIDELQKLKNIYFNSGKSLLNELFNLFVSLTKMEHLCHVICLTSDTLFIDNVYRNSSLSEASEYYLIDWLKKDDIKKILKEEGFNKKEIDYCLNYLSLPYEISQLINNKKLGLSVEETIKRWINIEADGIKYLIDTSDLNEEEIYKVLSKFKDKIKINYKKDVKKEEMKYIKFLIENEILFYDVINGIIKPTSVKKWYAIKEILDK

SEQ ID NO: 8 - protein, 342 aa, Methanococcus jannaschii
MKFYNREKELNYLKNYVQLEPNSILFVYGPKSSGKSTVMLRVIEELSKKDDLVFFYYDLREYATPTKEEFLEIFFEKGDKKYLLNRFEINLKIFKFGIEEKFDFDNIKLNDVFSKMKESINAVIKDGKKPILIIDELQKLKSIYFNGEGKGDKSLLNELFNLFVHLTKVRHLCHVICLTSDTLFIEEIYRNSTLENTSEYYLIDWLRKESIRNILKEEGFSEEEVDYCLKYLSLPYEISQLINNKKLGLSVEQTIKQWINIERDKILYLISTQKEFEMGKLIDALKLFENKIKVDIKEIIRDNLMDEVKFLIKNEILFYDVMNGIIKPTSVKKWYAIKEVIE

SEQ ID NO: 9 - protein, 357 aa, Methanococcus jannaschii
MEFFDREKEINYLVKVLSFEPNLIYFIYGPINSGKTTLIKHIIENKLDRDKYVVFYINLREHFISKYEDFIEVLFNTYEETFIEKLKKYLLSFINDLPKNIDVKSTILTGIPVPKNTLNEFLSTKNSENVFEYLTKIFEDIKKKGKQPILIIDELQKIGDLKINGFLIYELFNFFIDLTKEKHLCHVLCLSSDSLFIERVYNEGTLKDRCKYYLVDDFDYKTTKAFLKKHNFNDEEIDIVWHYFGGKPIKLVEAIQEKLLGEDVKEFCKKSLRVRKRQLKDLLYSLEDDNKELFERVIKLFENFKNRDEIFYEKISEEIVWTVKKNILFVNIEEGILKPQSKLDLLAIREILDEIKT

SEQ ID NO: 10 - protein, 363 aa, Methanococcus jannaschii
MKFYDREREINEILGILDETPDNIYFIYGPINSGKTTLMMEIINRLKDDKKYRIFYYNLRGVRISSYSDFFDIMFEIREDNKFKQMVKDADVLVEGIKFIEKTAKLFNESIILPSDLAKVILSKQKGFDVFRYLERVFREMNKKGLKPVIIIDELQRLKGLKSNGELIDDLFNFFVRLTKELHITHCFCLSSDSLFIEYVYDRAELRGRADYILVDDFDKETALKFMDFLSEDILGRKLSEDEKELIYSYVGGKPKDVYDVIIKLKLGKELKDILEFMLKEEIQKLKYFLEDVKEDDEELYNKIVDALKIFKENYEIEDIKIPKNIREFLVKKNILFLNPIEGTLKPQSFLVWNAIKKLLNGH

SEQ ID NO: 11 - protein, 374 aa, Methanococcus jannaschii
MKFYNREKEINKILSIIEGEPNNIYFIYGSLNSGKSTLMREIVVNRLDISKYIPFFIDFRTRNILNVDNFIECLFEVDEKSEIDDFREYAKSLADLLVKGSEEISKYYLGMPIKIPKPFFDKIFNKKDKSADVYQYIEYLFAKLNEKGKKPILIFDELQMIKEITLNGNRKLLWSLFQFLVALTKVQHLCHVFCLSSDSLFIEYVYKTGELEGRADYILVDDFDKQTALKFIDFLAKEILNKKLPKDEKELIYSYVGGKPVLIIKVIDKLRYENLNDILDFMLKDATQKLKYFLNDLDYIKPKVEVGDEVIELKKEDIVKALKLFKDSYEISDSEVAKPIYVYLVKKNILFLNPIEGILKPQSFLIWNAIKRLL

SEQ ID NO: 12 - protein, 365 aa, Methanococcus jannaschii
MKFYNREKEINEILLILEEEPNNIYFIYGPLNSGKSTLIREVITNRLDKSKYIPFFIDFRTRNILNVDNFIECLFEVDEKSKIDDFREYAKSLADLLVKGSEEISKYYLGMPIKVPKPFFDRIFSKRDKSADVYQYIEYLFAKLNEKGKKPILIFDELQMIREITLNGNRLLLWSLFQFLVALTKVQHLCHVFCLSSDSLFIEYIYGKAELKGGVDYILVDDFDKKTALKFMDFLAKQKNINLTNEDKELIYSYVGGKAKYIYDVIVKLKAVKDLKYILETKLEEERNHLEELLEKVEEDYEGINYDEVLEALKLFKDNYELPKSKIKRKIRIFLIKENILFLNPQKGTLKPQSYLVWNAIKRML

SEQ ID NO: 13 - protein, 367 aa, Methanococcus jannaschii
MKFYNREKEINEILRILNREPDDIYFIYGPLNSGKTTLINHIINNELKKSNKKYAVFYVNFREYDISSMDNFVEALFEIDENSKEKKIKSYIESFTKGVNDIINLYYGIKIPEPILDKFFGEKEKGGLVFKFIRDLFMSLNKKGVQPVFILDELQMIKDIVMNGGKPLLKSLFQFLVSLTKERHIAHVFCLSSDSLFIEYVYNAGELEGRAKYLLVDDFDKETSLKFMDFLAVEGNINLTNEDKELIYSYVGGKAKDIKYVIEESKFKDLREVLDFMLKDEVSKLRKLLVKIKTKKIAEVEYENVVKALKLFKDNYEINEYLMDENTKEFLIKRNILFLNPVEEILKPQSYLVWNAIKRVLQNINDF

SEQ ID NO: 14 - protein, 367 aa, Methanococcus jannaschii
MKFYNREKEIHEILSILEGEPNIIYFIYGPLNSGKTALIKHIIENKLSDDYKVFYINFRTYLISEKREFIEAIFTTKKDDFFEKIKDKSEVLNLITKGAKILTGIPIPEVEFDKLFEEKINDAFQYLNSILLEVKKSGKQPVLILDELQMIKDVVLNWQKYLLKELFQFLVSLTKEQHLCHVFCLSSDSLFIEYVYSAGELEGRAKYLLVDDFDKETALKFMDFLAKEILNKKLSDEDKELIYNYVGGKPVYIYSVIDEMRYRKLEDILNLMLKEETQKLKYFLKELDYIKPKVELKDEIIEIKKDDIINALKLFKENYEVSDDDIPEPVYIYLVKKNILFLNPIEGILKPQSFLIWNAIKKLLNGH

SEQ ID NO: 15 - protein, 379 aa, Methanococcus jannaschii
MKFYDREREINEILHILNREPDDIYFIYGPLNSGKTALIKHIIENKLSDDYKVFYINFRTYLISEKREFIEAIFTTKKDDFFEKIKDKDEVLNLITKGVRILTGIPIPEVEFDKLFEEKINDAFQYLNSLLLEVKKSGKKPILIFDELQMIKDVVLNTENQRFSAFPSLRFGNGQKYLLKELFQFLVSLTKEQHLCHVFCLSSDSLFIEYVYSTGELEGRAKYLLVDDFDKETALKFMDFLAVENNINLTNEDKELIYSYVGGKPKDIKYVVEESKFKDLREILEFMLKDAVQKLDMFLDMLNYSKPKVDVGDEVIEIKKDNVIEALKLFKDEYEVSKKHIPVPVYTYLIKRNILFLNPIEGILKPQSYLVWNAIKRLL

SEQ ID NO: 16 - protein, 393 aa, Methanococcus jannaschii
MKFYNREKEIHKILSIIEGEPNLIYFIYGSINSGKTALINEIINNRLDKNKYIVFYFDLREIFISKYDDFIEVLFEEYEGDKSPIEVIKAIINDLPSLYGIPIPKNTLNEIFKKKTTKNVFRYITNVLMDIKREGKQPIIIIDELQKIGDMKINGFLIYELFNYFVSLTKHKHLCHVFCLSSDSLFIERVYNEAMLEDRVDYILVDDHRGGYAPSIGILPQIESGVAFGNPALEYSNRGFASMRGEYILVDDFDKETALKFMDFLAKENNMSLTNEDKELIYNYVGGKPVLIIKVIDKLRYENLNDILDFMLKDATQKLKYFLEDVKEEDEELYKKVVDALKLFKEDYEIEDIKIPKKIREFLIKRNILFLNPIEGILKPQSFLVWNAIKKVL

SEQ ID NO: 17 - protein, 363 aa, Methanococcus jannaschii
MKFYNREKEIEEILHIIESEPQRINFIFGSINSGKTALINEIINNRLNKDKYVVFYFDLREIFISKYDDFIEVLFEEYEEPFIDKVKRLFLSLIKDYPDVIKSYALLNITGVVDSIPIPKNTLNELLKKRNVKNVFRYITSVLIKIKREGKQPIIIIDELQKIGDLKLNGFLIYELFNYFVSLTKHKHLCHVFCLSSDSLFIERVYNEAMLEGRCKYILVDDFDRETALKFMDFLAKENNINLTNEDKELIYNYVGGKPIDIIYVINEMKYKKLEDILTSMLKEETQKLKYFLENVKEEDEELYKKVVDALKIFKDSYEIEDIKIPKKLREFLVKKNILFLNPIEGILKPQSFLVWNAIKRIL

SEQ ID NO: 18 - protein, 374 aa, Methanococcus jannaschii
MKFYNRVEEIKEILSILEEEPNLIYFIYGPINSGKTALINEIINNRLDKNKYVVFYIDLREIFISKYDEFEAKLRATKTFGFRLIIEVLFEEYEDDKKPIEIIRSLIKDAPSLCGIPTPKNTLEEILKKKTTKNVFKYITNILMDIKREGKQPIIIIDELQKIGDMKINGFLIYELFNYFVSLTKHKHLCHVFCLSSDSLFIERVYNEAMLKERVDYILVDDFDKETALKFIDFLSEEILNKKLSDEDKELIYSYVGGKPILIINVIGKLKHKNLKDVLNILLMDEISKLKDFLSNLDYIKPKVNIEEEIIEIRKEDIINALKLFKGKYEIEVDKIPKAVYVYLVKKNILFLYPQRGILKPQSFLVWNAIKRVL

SEQ ID NO: 19 - protein, 358 aa, Methanococcus jannaschii
MKFYDREKEIAEILHILNREPDDVYFIYGPINSGKTALINEIINNRLDKDKYVVFYFDLREIFISKYDDFIEVLFEEYEGNKKPVEIIKSLIKDVPSLCGIPAPKNTLEEILKKKTTKNVFRYITKVLMDIKKEGKQPILIIDELQKIGDMKINGFLIYELFNYFVSLTKHKHLCHVFCLSSDSLFIERVYNEAMLDGRAKYLLVDDFDKETALKFMDFLAKENNISLTNEDKELIYNYVGGKPKDIKYVVEESNFKDLKEVLDYLLNDEISKLDMFLEILDYSKPRVEVGNEVIEINKEDIIKALRLFKDKYEIPKKDIPTPVYVYLVKENILFLNPQKRILKPQSYLVWNAIKRLL

SEQ ID NO: 20 - protein, 349 aa, Methanococcus jannaschii
MRFYNREKEITEILSILEGNPDLVYFVYGPLNSGKTALISEIINNRIDKNKYVVFYINLRGIFISKYKDFIEVLFEEYEEDRKPVEIIKSLIKDVPSLCGIPTPKNTLEEILKKKTTKNVFKYITNVLMDIKKEGKQPIIIIDELQKIGDMKINGFLIYELFNYFVDLTKELHLCHVFCLSSDSLFIEQVYSEAMLKDRVDYILVDDFDKETALKFMDFLAEEILNKKLSDDEKELIYSYVGGKPILIIKVIKKLKIKGLKETLDEMLRDEMQKLKYFLEDIKEKDEESYNKIADALEIFKDSYEIEDIKIPKNIREFLVKKNILFLNPQKGILKPQSYLVWNAIKRLL

What is claimed is:

1. An isolated polynucleotide comprising the nucleic acid sequence of ORF MJ0428, represented by nucleotides 1087456–1088655 of SEQ ID NO:1.

2. The isolated polynucleotide of claim 1, wherein said polynucleotide comprises a heterologous polynucleotide sequence.

3. The isolated polynucleotide of claim 2, wherein said heterologous polynucleotide sequence encodes a heterologous polypeptide.

4. A method for making a recombinant vector comprising inserting the isolated polynucleotide of claim 1 into a vector.

5. A nucleic acid sequence complimentary to the polynucleotide of claim 1.

6. A recombinant vector comprising the isolated polynucleotide of claim 1.

7. The recombinant vector of claim 6, wherein said polynucleotide is operably associated with a heterologous regulatory sequence that controls gene expression.

8. A recombinant host cell comprising the isolated polynucleotide of claim 1.

9. The recombinant host cell of claim 8, wherein said polynucleotide is operably associated with a heterologous regulatory sequence that controls gene expression.

10. An isolated polynucleotide fragment comprising a nucleic acid sequence which hybridizes under hybridization conditions, comprising hybridization in 5×SSC and 50% formamide at 50–65° C. and washing in a wash buffer consisting of 0.5×SSC at 50–65° C., to the complementary strand of ORF MJ0428, represented by nucleotides 1087456–1088655 of SEQ ID NO:1.

11. The isolated polynucleotide of claim 10, wherein said polynucleotide comprises a heterologous polynucleotide sequence.

12. The isolated polynucleotide of claim 11, wherein said heterologous polynucleotide sequence encodes a heterologous polypeptide.

13. A method for making a recombinant vector comprising inserting the isolated polynucleotide of claim 10 into a vector.

14. A nucleic acid sequence complimentary to the polynucleotide of claim 10.

15. A recombinant vector comprising the isolated polynucleotide of claim 10.

16. The recombinant vector of claim 15 wherein said polynucleotide is operably associated with a heterologous regulatory sequence that controls gene expression.

17. A recombinant host cell comprising the isolated polynucleotide of claim 10.

18. The recombinant host cell of claim 17, wherein said polynucleotide is operably associated with a heterologous regulatory sequence that controls gene expression.

19. An isolated polynucleotide for the detection of *Methanococcus jannaschii*, wherein said isolated polynucleotide comprises at least 30 contiguous nucteotides of the nucleic acid sequence of ORF MJ0428, represented by nucleotides 1087456–1088655 of SEQ ID NO:1.

20. The isolated polynucleotide of claim 19, wherein said polynucleotide comprises a heterologous polynucleotide sequence.

21. The isolated polynucleotide of claim 20, wherein said heterologous polynucleotide sequence encodes a heterologous polypeptide.

22. A method for making a recombinant vector comprising inserting the isolated polynucleotide of claim 19 into a vector.

23. A nucleic acid sequence complimentary to the polynucleotide of claim 19.

24. A recombinant vector comprising the isolated polynucleotide of claim 19.

25. The recombinant vector of claim 24, wherein said polynucleotide is operably associated with a heterologous regulatory sequence that controls gene expression.

26. A recombinant host cell comprising the isolated polynucleotide of claim 19.

27. The recombinant host cell of claim 26, wherein said polynucleotide is operably associated with a heterologous regulatory sequence that controls gene expression.

28. The isolated polynucleotide of claim 19, wherein said isolated polynucleotide comprises at least 40 contiguous nucleotides of the nucleic acid sequence of ORF MJ0428, represented by nucleotides 1087456–1088655 of SEQ ID NO:1.

29. A method for detecting *Methanococcus jannaschii* comprising:
   (a) contacting a biological sample with the isolated polynucleotide of claim 10 under conditions suitable for the hybridization of said polynucleotide to a nucleic acid molecule complementary thereto; and
   (b) detecting the presence or absence of *Methanococcus jannaschii* in the biological sample.

30. A method for detecting *Methanococcus jannaschii* comprising:
   (a) contacting said biological sample with the isolated polynucleotide of claim 19 under conditions suitable for the hybridization of said polynucleotide to a nucleic acid molecule complementary thereto; and
   (b) detecting the presence or absence of *Methanococcus jannaschii* in the biological sample.

31. A method for detecting *Methanococcus jannaschii* comprising:
   (a) contacting said biological sample with the isolated polynucleotide of claim 28 under conditions suitable for the hybridization of said polynucleotide to a nucleic acid molecule complementary thereto; and
   (b) detecting the presence or absence of *Methanococcus jannaschii* in the biological sample.

\* \* \* \* \*